United States Patent 11,446,398 (REGULATED BIOCIRCUIT SYSTEMS) - sequence listing, part 19

SEQ ID NO: 84291 - protein, 431 aa, Homo sapiens
  Payload ID: 16770
  Gene Symbol: STRADA
  Gene Name: STE20-related kinase adaptor alpha
  Uniprot ID: Q7RTN6
  ENSP ID: ENSP00000336655
MSFLVSKPERIRRWVSEKFIVEGLRDLELFGEQPPGDTRRKTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 84292 - protein, 373 aa, Homo sapiens
  Payload ID: 16770
  Gene Symbol: STRADA
  Gene Name: STE20-related kinase adaptor alpha
  Uniprot ID: Q7RTN6
  ENSP ID: ENSP00000365000
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 84293 - protein, 348 aa, Homo sapiens
  Payload ID: 16770
  Gene Symbol: STRADA
  Gene Name: STE20-related kinase adaptor alpha
  Uniprot ID: Q7RTN6
  ENSP ID: ENSP00000376677
MSFLTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARYPCWPGPGLRESRGCSGG

SEQ ID NO: 84294 - protein, 299 aa, Homo sapiens
  Payload ID: 16770
  Gene Symbol: STRADA
  Gene Name: STE20-related kinase adaptor alpha
  Uniprot ID: Q7RTN6
  ENSP ID: ENSP00000398841
MSFLVSKPERIRRWVSEKFIVEGLRDLELFGGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGPVPAPS

SEQ ID NO: 84295 - protein, 72 aa, Homo sapiens
  Payload ID: 16770
  Gene Symbol: STRADA
  Gene Name: STE20-related kinase adaptor alpha
  ENSP ID: ENSP00000462384
MSFLTNDASSESIASFSKQEVMSSFLPEGGCYELLTVIGKGFEDLMTVNLARYKPTGEYVTVRRINLEACSN

SEQ ID NO: 84296 - protein, 10 aa, Homo sapiens
  Payload ID: 16770
  Gene Symbol: STRADA
  Gene Name: STE20-related kinase adaptor alpha
  ENSP ID: ENSP00000462496
MSSFLPEGGC

SEQ ID NO: 84297 - protein, 173 aa, Homo sapiens
  Payload ID: 16770
  Gene Symbol: STRADA
  Gene Name: STE20-related kinase adaptor alpha
  ENSP ID: ENSP00000462530
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRISRVMMPSLTSTVWESQPVNWPTAMSPLRICLPPRCC

SEQ ID NO: 84298 - protein, 314 aa, Homo sapiens
  Payload ID: 16770
  Gene Symbol: STRADA
  Gene Name: STE20-related kinase adaptor alpha
  Uniprot ID: Q7RTN6
  ENSP ID: ENSP00000462922
MSFLVSKPERIRTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGPVPAPS

SEQ ID NO: 84299 - protein, 78 aa, Homo sapiens
  Payload ID: 16770
  Gene Symbol: STRADA
  Gene Name: STE20-related kinase adaptor alpha
  ENSP ID: ENSP00000463203
MSSFLPEGGCYELLTVIGKGFEDLMTVNLARYKPTGEYVTVRRINLEACSNEMVTFLQGELHVSKLFNHPNIVPYRAT

SEQ ID NO: 84300 - protein, 45 aa, Homo sapiens
  Payload ID: 16770
  Gene Symbol: STRADA
  Gene Name: STE20-related kinase adaptor alpha
  ENSP ID: ENSP00000463238
MSFLVSKPERIRRWVSEKFIVEGLRDLELFGEQPPGDTRRKTNDA

SEQ ID NO: 84301 - protein, 131 aa, Homo sapiens
  Payload ID: 16770
  Gene Symbol: STRADA
  Gene Name: STE20-related kinase adaptor alpha
  ENSP ID: ENSP00000463872
LEACSNEMVTFLQGELHVSKLFNHPNIVPYRATFIADNELWVVTSFMAYGSAKDLICTHFMDGMNELAIAYILQGVLKALDYIHHMGYVHRISRVMMPSLTSTVWESQPVNWPTAMSPLRICLPPRVKTLR

SEQ ID NO: 84302 - protein, 40 aa, Homo sapiens
  Payload ID: 16770
  Gene Symbol: STRADA
  Gene Name: STE20-related kinase adaptor alpha
  ENSP ID: ENSP00000464085
MSFLVSKPERIRRWVSEKFIVEGLRDLELFGGESPKSREQ

SEQ ID NO: 84303 - protein, 50 aa, Homo sapiens
  Payload ID: 16770
  Gene Symbol: STRADA
  Gene Name: STE20-related kinase adaptor alpha
  ENSP ID: ENSP00000464139
MSSFLPEGGCYELLTVIGKGFEDLMTVNLARYKPTGEYVTVRRINLEACS

SEQ ID NO: 84304 - protein, 55 aa, Homo sapiens
  Payload ID: 16770
  Gene Symbol: STRADA
  Gene Name: STE20-related kinase adaptor alpha
  ENSP ID: ENSP00000464213
  MOD_RES (1)..(1): Any amino acid
XSTPRPSNGDSPSHPYHRTFSPHFHHFVEQCLQRNPDARPSASTLLNHSFFKQVS

SEQ ID NO: 84305 - protein, 167 aa, Homo sapiens
  Payload ID: 16770
  Gene Symbol: STRADA
  Gene Name: STE20-related kinase adaptor alpha
  ENSP ID: ENSP00000464547
NIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQGEDSTVKGI

SEQ ID NO: 84306 - protein, 234 aa, Homo sapiens; identical to SEQ ID NO: 84290
  Payload ID: 16770
  Gene Symbol: STRADA
  Gene Name: STE20-related kinase adaptor alpha
  ENSP ID: ENSP00000481505

SEQ ID NO: 84307 - protein, 418 aa, Homo sapiens
  Payload ID: 16771
  Gene Symbol: STRADB
  Gene Name: STE20-related kinase adaptor beta
  Uniprot ID: Q9C0K7
  ENSP ID: ENSP00000194530
MSLLDCFCTSRTQVESLRPEKQSETSIHQYLVDEPTLSWSRPSTRASEVLCSTNVSHYELQVEIGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQMKEESQDSILSLLPPAYNKPSISLPPVLPWTEPECDFPDEKDSYWEF

SEQ ID NO: 84308 - protein, 377 aa, Homo sapiens
  Payload ID: 16771
  Gene Symbol: STRADB
  Gene Name: STE20-related kinase adaptor beta
  Uniprot ID: Q9C0K7
  ENSP ID: ENSP00000376080
MSLLDCFCTSRTQVESLRPEKQSETSIHQYLVDEPTLSWSRPSTRASEVLCSTNVSHYELQVEIGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQPYFEFL

SEQ ID NO: 84309 - protein, 37 aa, Homo sapiens
  Payload ID: 16771
  Gene Symbol: STRADB
  Gene Name: STE20-related kinase adaptor beta
  ENSP ID: ENSP00000404359
MSLLDCFCTSRTQVESLRPEKQSETSIHQYLEEDLTT

SEQ ID NO: 84310 - protein, 194 aa, Homo sapiens
  Payload ID: 16771
  Gene Symbol: STRADB
  Gene Name: STE20-related kinase adaptor beta
  ENSP ID: ENSP00000409552
MTQTSPFYNGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKS

SEQ ID NO: 84311 - protein, 89 aa, Homo sapiens
  Payload ID: 16771
  Gene Symbol: STRADB
  Gene Name: STE20-related kinase adaptor beta
  ENSP ID: ENSP00000413574
  MOD_RES (1)..(1): Any amino acid
XPVGRCLSRTCIELSLVQLCLQQDPEKRPSASSLLSHVFFKQMKEESQDSILSLLPPAYNKPSISLPPVLPWTEPECDFPDEKDSYWEF

SEQ ID NO: 84312 - protein, 342 aa, Homo sapiens
  Payload ID: 16772
  Gene Symbol: STEAP1B
  Gene Name: STEAP family member 1B
  Uniprot ID: Q6NZ63
  ENSP ID: ENSP00000384370
MESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQAILTGSLVALCNFQATKLAKTQLVGTPNFWQEQQCGIHFPPPSKTRSYIYFILSAASPSKGNVSSHMFQLHLENLNKKDKLLLIIFQI

SEQ ID NO: 84313 - protein, 245 aa, Homo sapiens
  Payload ID: 16772
  Gene Symbol: STEAP1B
  Gene Name: STEAP family member 1B
  Uniprot ID: Q6NZ63
  ENSP ID: ENSP00000385239
MESRKDITNQEEIWKMKPRRNLEDNDYLQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQVHGRINFLTL

SEQ ID NO: 84314 - protein, 216 aa, Homo sapiens
  Payload ID: 16772
  Gene Symbol: STEAP1B
  Gene Name: STEAP family member 1B
  ENSP ID: ENSP00000408954
MESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRM

SEQ ID NO: 84315 - protein, 254 aa, Homo sapiens
  Payload ID: 16772
  Gene Symbol: STEAP1B
  Gene Name: STEAP family member 1B
  ENSP ID: ENSP00000416608
MESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQ

SEQ ID NO: 84316 - protein, 490 aa, Homo sapiens
  Payload ID: 16773
  Gene Symbol: STEAP2
  Gene Name: STEAP family member 2, metalloreductase
  Uniprot ID: Q8NFT2
  ENSP ID: ENSP00000287908
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 84317 - protein, 490 aa, Homo sapiens; identical to SEQ ID NO: 84316
  Payload ID: 16773
  Gene Symbol: STEAP2
  Gene Name: STEAP family member 2, metalloreductase
  Uniprot ID: Q8NFT2
  ENSP ID: ENSP00000378119

SEQ ID NO: 84318 - protein, 490 aa, Homo sapiens; identical to SEQ ID NO: 84316
  Payload ID: 16773
  Gene Symbol: STEAP2
  Gene Name: STEAP family member 2, metalloreductase
  Uniprot ID: Q8NFT2
  ENSP ID: ENSP00000378120

SEQ ID NO: 84319 - protein, 454 aa, Homo sapiens
  Payload ID: 16773
  Gene Symbol: STEAP2
  Gene Name: STEAP family member 2, metalloreductase
  Uniprot ID: Q8NFT2
  ENSP ID: ENSP00000378123
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILDLLQLCRYPD

SEQ ID NO: 84320 - protein, 454 aa, Homo sapiens; identical to SEQ ID NO: 84319
  Payload ID: 16773
  Gene Symbol: STEAP2
  Gene Name: STEAP family member 2, metalloreductase
  Uniprot ID: Q8NFT2
  ENSP ID: ENSP00000378125

SEQ ID NO: 84321 - protein, 419 aa, Homo sapiens
  Payload ID: 16773
  Gene Symbol: STEAP2
  Gene Name: STEAP family member 2, metalloreductase
  Uniprot ID: Q8NFT2
  ENSP ID: ENSP00000378128
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQIFCSFADTQTELELEFVFLLTLLL

SEQ ID NO: 84322 - protein, 403 aa, Homo sapiens
  Payload ID: 16773
  Gene Symbol: STEAP2
  Gene Name: STEAP family member 2, metalloreductase
  ENSP ID: ENSP00000384191
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQWPSATLLS

SEQ ID NO: 84323 - protein, 181 aa, Homo sapiens
  Payload ID: 16773
  Gene Symbol: STEAP2
  Gene Name: STEAP family member 2, metalloreductase
  ENSP ID: ENSP00000401783
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIEL

SEQ ID NO: 84324 - protein, 88 aa, Homo sapiens
  Payload ID: 16773
  Gene Symbol: STEAP2
  Gene Name: STEAP family member 2, metalloreductase
  ENSP ID: ENSP00000415931
MESISMMGSPKSLSETFLPNGINGIKDARKVTVGVIGSGDFAKSLTIRLIRCGYHVVIGSRNPKFASEFFPHVVDVTHHEDALTKTNI

SEQ ID NO: 84325 - protein, 488 aa, Homo sapiens
  Payload ID: 16774
  Gene Symbol: STEAP3
  Gene Name: STEAP family member 3, metalloreductase
  Uniprot ID: Q658P3
  ENSP ID: ENSP00000376818
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 84326 - protein, 488 aa, Homo sapiens; identical to SEQ ID NO: 84325
  Payload ID: 16774
  Gene Symbol: STEAP3
  Gene Name: STEAP family member 3, metalloreductase
  Uniprot ID: Q658P3
  ENSP ID: ENSP00000376819

SEQ ID NO: 84327 - protein, 498 aa, Homo sapiens
  Payload ID: 16774
  Gene Symbol: STEAP3
  Gene Name: STEAP family member 3, metalloreductase
  Uniprot ID: Q658P3
  ENSP ID: ENSP00000376822
MSHQPAVATKMPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 84328 - protein, 457 aa, Homo sapiens
  Payload ID: 16774
  Gene Symbol: STEAP3
  Gene Name: STEAP family member 3, metalloreductase
  ENSP ID: ENSP00000386510
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQCVATSSAGNTGSGTRRPESQSQDPHLPAPHHQTSFLGPRSFCCSLVPVSTPYGHQEDLSWTR

SEQ ID NO: 84329 - protein, 283 aa, Homo sapiens
  Payload ID: 16775
  Gene Symbol: STEAP4
  Gene Name: STEAP family member 4
  Uniprot ID: Q687X5
  ENSP ID: ENSP00000305545
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 84330 - protein, 459 aa, Homo sapiens
  Payload ID: 16775
  Gene Symbol: STEAP4
  Gene Name: STEAP family member 4
  Uniprot ID: Q687X5
  ENSP ID: ENSP00000369419
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQVFVCGNDSKAKQRVMDIVRNLGLTPMDQGSLMAAKEIEKYPLQLFPMWRFPFYLSAVLCVFLFFYCVIRDVIYPYVYEKKDNTFRMAISIPNRIFPITALTLLALVYLPGVIAAILQLYRGTKYRRFPDWLDHWMLCRKQLGLVALGFAFLHVLYTLVIPIRYYVRWRLGNLTVTQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 84331 - protein, 339 aa, Homo sapiens
  Payload ID: 16775
  Gene Symbol: STEAP4
  Gene Name: STEAP family member 4
  ENSP ID: ENSP00000394399
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQVFVCGNDSKAKQRVMDIVRNLGLTPMDQGSLMAAKEIEKYPLQLFPMWRFPFYLSAVLCVFLFFYCVIRDVIYPYVYEKKDNTFRMAISIPNRIFPITALTLLALVYLPGVIAAILQLYRGTKYRRFPDWLDHWMLCRKQLGLVALGFAFLHVLYTLVIPIRYYVRWRLGNLTVTQVNLFLYIFFCS

SEQ ID NO: 84332 - protein, 359 aa, Homo sapiens
  Payload ID: 16776
  Gene Symbol: SCD
  Gene Name: stearoyl-CoA desaturase (delta-9-desaturase)
  Uniprot ID: O00767
  ENSP ID: ENSP00000359380
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 84333 - protein, 256 aa, Homo sapiens
  Payload ID: 16777
  Gene Symbol: SCD5
  Gene Name: stearoyl-CoA desaturase 5
  Uniprot ID: Q86SK9
  ENSP ID: ENSP00000273908
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRNTQHIQKEGRALNQEAACEMLREWHQGHILKVTLPGLHILALLHTHCNHSEKCCLMLRALSVSLEVF

SEQ ID NO: 84334 - protein, 330 aa, Homo sapiens
  Payload ID: 16777
  Gene Symbol: SCD5
  Gene Name: stearoyl-CoA desaturase 5
  Uniprot ID: Q86SK9
  ENSP ID: ENSP00000316329
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 84335 - protein, 277 aa, Homo sapiens
  Payload ID: 16778
  Gene Symbol: SLBP
  Gene Name: stem-loop binding protein
  ENSP ID: ENSP00000316490
MACRPRSPPRHQSRCDGDASPPSPARWSLGRKRRADGRRWRPEDAEEAEHRGAERRPESFTTPEGPKPRSRCSDWASAVEEDEMRTRVNKEMASNIYFALRYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 84336 - protein, 231 aa, Homo sapiens
  Payload ID: 16778
  Gene Symbol: SLBP
  Gene Name: stem-loop binding protein
  Uniprot ID: Q14493
  ENSP ID: ENSP00000406322
MACRPRSPPRHQSRCDGDASFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 84337 - protein, 186 aa, Homo sapiens
  Payload ID: 16778
  Gene Symbol: SLBP
  Gene Name: stem-loop binding protein
  ENSP ID: ENSP00000417359
  MOD_RES (1)..(1): Any amino acid
XKAVGGGARRARERRRGDAGFCLRPCPALLCALCPRRRRLSLGPALRARPEDAEEAEHRGAERRPESFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKY

SEQ ID NO: 84338 - protein, 270 aa, Homo sapiens
  Payload ID: 16778
  Gene Symbol: SLBP
  Gene Name: stem-loop binding protein
  Uniprot ID: Q14493
  ENSP ID: ENSP00000417686
MACRPRSPPRHQSRCDGDASPPSPARWSLGRKRRADGRRWRPEDAEEAEHRGAERRPESFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 84339 - protein, 235 aa, Homo sapiens
  Payload ID: 16778
  Gene Symbol: SLBP
  Gene Name: stem-loop binding protein
  ENSP ID: ENSP00000418658
MACRPRSPPRHQSRCDGDASPPSPARWSLGRKRRADGRRWRPEDAEEAEHRGAERRPERYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 84340 - protein, 225 aa, Homo sapiens
  Payload ID: 16778
  Gene Symbol: SLBP
  Gene Name: stem-loop binding protein
  ENSP ID: ENSP00000426891
  MOD_RES (1)..(1): Any amino acid
XPADRVPPRSPPSPARWSLGRKRRADGRRWRPEDAEEAEHRGAERRPERYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 84341 - protein, 119 aa, Homo sapiens
  Payload ID: 16779
  Gene Symbol: STRC
  Gene Name: stereocilin
  ENSP ID: ENSP00000394755
  MOD_RES (1)..(1): Any amino acid
XSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRWHMNFWVCCAHLEERC

SEQ ID NO: 84342 - protein, 351 aa, Homo sapiens
  Payload ID: 16779
  Gene Symbol: STRC
  Gene Name: stereocilin
  ENSP ID: ENSP00000394866
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEAL

SEQ ID NO: 84343 - protein, 1775 aa, Homo sapiens
  Payload ID: 16779
  Gene Symbol: STRC
  Gene Name: stereocilin
  Uniprot ID: Q7RTU9
  ENSP ID: ENSP00000401513
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLSLEELCSLHLLLPGLSPQTLQAIPRRVLVGACSCLAPELSRLSACQTAALLQTFRVKDGVKNMGTTGAGPAVCIPGQPIPTTWPDCLLPLLPLKLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 84344 - protein, 663 aa, Homo sapiens
  Payload ID: 16779
  Gene Symbol: STRC
  Gene Name: stereocilin
  ENSP ID: ENSP00000407303
TFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSVSALPEGKLLEQ

SEQ ID NO: 84345 - protein, 969 aa, Homo sapiens
  Payload ID: 16779
  Gene Symbol: STRC
  Gene Name: stereocilin
  ENSP ID: ENSP00000415991
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRWHMNFWVCCAHLEERC

SEQ ID NO: 84346 - protein, 1002 aa, Homo sapiens
  Payload ID: 16779
  Gene Symbol: STRC
  Gene Name: stereocilin
  ENSP ID: ENSP00000440413
MELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 84347 - protein, 107 aa, Homo sapiens
  Payload ID: 16780
  Gene Symbol: SARM1
  Gene Name: sterile alpha and TIR motif containing 1
  ENSP ID: ENSP00000462228
  MOD_RES (1)..(1): Any amino acid
XASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIK

SEQ ID NO: 84348 - protein, 257 aa, Homo sapiens
  Payload ID: 16780
  Gene Symbol: SARM1
  Gene Name: sterile alpha and TIR motif containing 1
  ENSP ID: ENSP00000462479
  MOD_RES (1)..(1): Any amino acid
XNLADWLGSLDPRFRQYTYGLVSCGLDRSLLHRVSEQQLLEDCGIHLGVHRARILTAARVSDAEGPPSPCCLLPTSEMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 84349 - protein, 118 aa, Homo sapiens
  Payload ID: 16780
  Gene Symbol: SARM1
  Gene Name: sterile alpha and TIR motif containing 1
  ENSP ID: ENSP00000464166
  MOD_RES (1)..(1): Any amino acid
XLLPQEQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAARAITD

SEQ ID NO: 84350 - protein, 724 aa, Homo sapiens
  Payload ID: 16780
  Gene Symbol: SARM1
  Gene Name: sterile alpha and TIR motif containing 1
  Uniprot ID: Q6SZW1
  ENSP ID: ENSP00000468032
MVLTLLLSAYKLCRFFAMSGPRPGAERLAVPGPDGGGGTGPWWAAGGRGPREVSPGAGTEVQDALERALPELQQALSALKQAGGARAVGAGLAEVFQLVEEAWLLPAVGREVAQGLCDAIRLDGGLDLLLRLLQAPELETRVQAARLLEQILVAENRDRVARIGLGVILNLAKEREPVELARSVAGILEHMFKHSEETCQRLVAAGGLDAVLYWCRRTDPALLRHCALALGNCALHGGQAVQRRMVEKRAAEWLFPLAFSKEDELLRLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 84351 - protein, 129 aa, Homo sapiens
  Payload ID: 16781
  Gene Symbol: SAMD1
  Gene Name: sterile alpha motif domain containing 1
  ENSP ID: ENSP00000269724
MAAMNKEGGTASVATGPDSPSPVPLPPGKPALPGADGTPFGCPPGRKEKPSDPVEWTVMDVVEYFTEAGFPEQATAFQEQEIDGKSLLLMQRTDVLTGLSIRLGPALKIYEHHIKVLQQGHFEDDDPDG

SEQ ID NO: 84352 - protein, 432 aa, Homo sapiens
  Payload ID: 16781
  Gene Symbol: SAMD1
  Gene Name: sterile alpha motif domain containing 1
  ENSP ID: ENSP00000431971
MAGPPALPPPETAAAATTAAAASSSAASPHYQEWILDTIDSLRSRKARPDLERICRMVRRRHGPEPERTRAELEKLIQQRAVLRVSYKGSISYRNAARVQPPRRGATPPAPPAPPQQQQPPPPQPQPPPEGGAVRAGGAARPVSLREVVRYLGGSGGAGGRLTRGRVQGLLEEEAAARGRLERTRLGALALPRGDRPGRAPPAASARPSRSKRGGEERVLEKEEEEDDDEDEDEEDDVSEGSEVPESDRPAGAQHHQLNGERGPQSAKERVKEWTPCGPHQGQDEGRGPAPGSGTRQVFSMAAMNKEGGTASVATGPDSPSPVPLPPGKPALPGADGTPFGCPPGRKEKPSDPVEWTVMDVVEYFTEAGFPEQATAFQEQEIDGKSLLLMQRTDVLTGLSIRLGPALKIYEHHIKVLQQGHFEDDDPDGFLG

SEQ ID NO: 84353 - protein, 202 aa, Homo sapiens
  Payload ID: 16782
  Gene Symbol: SAMD10
  Gene Name: sterile alpha motif domain containing 10
  Uniprot ID: Q9BYL1
  ENSP ID: ENSP00000358902
MFTELRSKLSPPRGRAGAVRAGFGERRDVDATAHFSFCRTLLEHTVSAESIPCHLPRTPGTSLTWHDSRSQRAASSRPIKLLQQPGTDTPQGRLYSDHYGLYHTSPSLGGLTRPVVLWSQQDVCKWLKKHCPHNYLVYVEAFSQHAITGRALLRLNAEKLQRMGLAQEAQRQEVLQQVLRLQVREEGRSLQLLSQASFGKMS

SEQ ID NO: 84354 - protein, 106 aa, Homo sapiens
  Payload ID: 16782
  Gene Symbol: SAMD10
  Gene Name: sterile alpha motif domain containing 10
  ENSP ID: ENSP00000404839
MFTELRSKLSPPRGRAGAVRAGFGERRDVDGSVHLQIPYRAFIHSFIDNECGVPLCNQTWIKTPASPDSATAHFSFCRTLLEHTVSAESIPCHLPRTPGTSLTWHD

SEQ ID NO: 84355 - protein, 681 aa, Homo sapiens
  Payload ID: 16783
  Gene Symbol: SAMD11
  Gene Name: sterile alpha motif domain containing 11
  Uniprot ID: Q96NU1
  ENSP ID: ENSP00000342313
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 84356 - protein, 589 aa, Homo sapiens
  Payload ID: 16783
  Gene Symbol: SAMD11
  Gene Name: sterile alpha motif domain containing 11
  ENSP ID: ENSP00000349216
  MOD_RES (1)..(1): Any amino acid
XHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 84357 - protein, 109 aa, Homo sapiens
  Payload ID: 16783
  Gene Symbol: SAMD11
  Gene Name: sterile alpha motif domain containing 11
  ENSP ID: ENSP00000393181
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPT

SEQ ID NO: 84358 - protein, 179 aa, Homo sapiens
  Payload ID: 16783
  Gene Symbol: SAMD11
  Gene Name: sterile alpha motif domain containing 11
  ENSP ID: ENSP00000411579
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLP

SEQ ID NO: 84359 - protein, 541 aa, Homo sapiens
  Payload ID: 16783
  Gene Symbol: SAMD11
  Gene Name: sterile alpha motif domain containing 11
  ENSP ID: ENSP00000412228
  MOD_RES (1)..(1): Any amino acid
XALLLPRELGPSMAPEDHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVRRWGVRSGSPDHSWAESSGWVCDSPHQAISLQVARRLGRVFYVASFPVALPLQPPTLRAPERELGTGEQPLSPTTATSPYGGGHALAGQTSPKQENGTLALLPGAPDPSQPLC

SEQ ID NO: 84360 - protein, 345 aa, Homo sapiens
  Payload ID: 16783
  Gene Symbol: SAMD11
  Gene Name: sterile alpha motif domain containing 11
  ENSP ID: ENSP00000478421
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHGEDPPWHDPPHHLPSHGSCLSRPPCCRRRMPLTSPWAPISGPPSWGCPRLCARPQATASCPPRRRRCSPGSRSSCGSRTWPGWSCPPTSCGRRSWRARAHSCWRPRPPCAPTTAPRSCSGAGPCWC

SEQ ID NO: 84361 - protein, 321 aa, Homo sapiens
  Payload ID: 16783
  Gene Symbol: SAMD11
  Gene Name: sterile alpha motif domain containing 11
  ENSP ID: ENSP00000480678
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSGCSSEGPQWPGSPPALLHGRSASEAGPGSAPGGRRPSCRPVLLGEGAASAAPLAVAAECPSRRPGPPSQAPLPGGALGSVPDPRLRLPAPRAGGDVRLAAGAPAEAEPGPAGAARRPPAAEGAGERAPTAAGARDRPAPQRRRRGAAAARGPAGAEPRRGATAGPAPPGAPGLRTPHPVPGLCPASPPEGGSRPCLSAAQRVQGDDGG

SEQ ID NO: 84362 - protein, 556 aa, Homo sapiens
  Payload ID: 16783
  Gene Symbol: SAMD11
  Gene Name: sterile alpha motif domain containing 11
  ENSP ID: ENSP00000480870
MSKGILQVHPPICDCPGCRISSPVNRGRLADKRTVALPAARNLKKERTPSFSASDGDSDGSGPTCGRRPGLKQEDGPHIRIMKRSQDGNLPTLISSVHRSRHLVMPEHQSRCEFQRGSLEIGLRPAGDLLGKRLGRSPRISSDCFSEKRARSESPQAEALLLPRELGPSMAPEDHYRRLVSALSEASTFEDPQRLYHLGLPSHGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 84363 - protein, 601 aa, Homo sapiens
  Payload ID: 16783
  Gene Symbol: SAMD11
  Gene Name: sterile alpha motif domain containing 11
  ENSP ID: ENSP00000482090
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHDLLRVRQEVAAAALRGPSGLEAHLPSSTAGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 84364 - protein, 682 aa, Homo sapiens
  Payload ID: 16783
  Gene Symbol: SAMD11
  Gene Name: sterile alpha motif domain containing 11
  ENSP ID: ENSP00000482138
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQAEALLLPRELGPSMAPEDHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 84365 - protein, 619 aa, Homo sapiens
  Payload ID: 16783
  Gene Symbol: SAMD11
  Gene Name: sterile alpha motif domain containing 11
  ENSP ID: ENSP00000484256
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 84366 - protein, 573 aa, Homo sapiens
  Payload ID: 16783
  Gene Symbol: SAMD11
  Gene Name: sterile alpha motif domain containing 11
  ENSP ID: ENSP00000484643
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQAEALLLPRELGPSMAPEDHYRRLVSALSEASTFEDPQRLYHLGLPSHGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 84367 - protein, 226 aa, Homo sapiens
  Payload ID: 16783
  Gene Symbol: SAMD11
  Gene Name: sterile alpha motif domain containing 11
  ENSP ID: ENSP00000484820
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCRLRLPAPRAGGDVRLAAGAPAEAEPGPAGAARRPPAAEGAGERAPTAAGARDRPAPQRRRRGAAAARGPAGAEPRRGATAGPAPPGAPGLRTPHPVPGLCPASPPEGGSRPCLSAAQRVQGDDGG

SEQ ID NO: 84368 - protein, 201 aa, Homo sapiens
  Payload ID: 16784
  Gene Symbol: SAMD12
  Gene Name: sterile alpha motif domain containing 12
  Uniprot ID: Q8N8I0
  ENSP ID: ENSP00000314173
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQGTLLLPDGWMDGEIRRKTTLLLGQTGVRENLLLFLHRISIIENSIQI

SEQ ID NO: 84369 - protein, 161 aa, Homo sapiens
  Payload ID: 16784
  Gene Symbol: SAMD12
  Gene Name: sterile alpha motif domain containing 12
  ENSP ID: ENSP00000387133
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQASSEGSP

SEQ ID NO: 84370 - protein, 68 aa, Homo sapiens
  Payload ID: 16784
  Gene Symbol: SAMD12
  Gene Name: sterile alpha motif domain containing 12
  ENSP ID: ENSP00000387605
MAVEALHCGLNPRGIDHPAHAEGIKLQIEGEGVESQSIKNKNFQKVPDQKGTPKRLQAEAETAKGEPC

SEQ ID NO: 84371 - protein, 148 aa, Homo sapiens
  Payload ID: 16784
  Gene Symbol: SAMD12
  Gene Name: sterile alpha motif domain containing 12
  ENSP ID: ENSP00000402786
  MOD_RES (1)..(1): Any amino acid
XALHCGLNPRGIDHPAHAEGIKLQIEGEGVESQSIKNKNFQKVPDQKGTPKRLQAEAETAKSATVKLSKPVALWTQQDVCKWLKKHCPNQYQIYRRALLRLTDKKLERMGIAQENLRQHILQQVLQLKVREEVRNLQLLTQASSEGSP

SEQ ID NO: 84372 - protein, 154 aa, Homo sapiens
  Payload ID: 16784
  Gene Symbol: SAMD12
  Gene Name: sterile alpha motif domain containing 12
  ENSP ID: ENSP00000431360
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQ

SEQ ID NO: 84373 - protein, 169 aa, Homo sapiens
  Payload ID: 16784
  Gene Symbol: SAMD12
  Gene Name: sterile alpha motif domain containing 12
  ENSP ID: ENSP00000434079
  MOD_RES (1)..(1): Any amino acid
XALRAPSREPAASLCVTAAALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQ

SEQ ID NO: 84374 - protein, 153 aa, Homo sapiens
  Payload ID: 16784
  Gene Symbol: SAMD12
  Gene Name: sterile alpha motif domain containing 12
  ENSP ID: ENSP00000435927
GLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQASSEGSP

SEQ ID NO: 84375 - protein, 102 aa, Homo sapiens
  Payload ID: 16785
  Gene Symbol: SAMD13
  Gene Name: sterile alpha motif domain containing 13
  Uniprot ID: Q5VXD3
  ENSP ID: ENSP00000359702
MLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 84376 - protein, 102 aa, Homo sapiens; identical to SEQ ID NO: 84375
  Payload ID: 16785
  Gene Symbol: SAMD13
  Gene Name: sterile alpha motif domain containing 13
  Uniprot ID: Q5VXD3
  ENSP ID: ENSP00000359703

SEQ ID NO: 84377 - protein, 102 aa, Homo sapiens; identical to SEQ ID NO: 84375
  Payload ID: 16785
  Gene Symbol: SAMD13
  Gene Name: sterile alpha motif domain containing 13
  Uniprot ID: Q5VXD3
  ENSP ID: ENSP00000359704

SEQ ID NO: 84378 - protein, 122 aa, Homo sapiens
  Payload ID: 16785
  Gene Symbol: SAMD13
  Gene Name: sterile alpha motif domain containing 13
  Uniprot ID: Q5VXD3
  ENSP ID: ENSP00000359705
MANSLLEGVFAEVKEPCSLPMLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 84379 - protein, 116 aa, Homo sapiens
  Payload ID: 16785
  Gene Symbol: SAMD13
  Gene Name: sterile alpha motif domain containing 13
  Uniprot ID: Q5VXD3
  ENSP ID: ENSP00000359707
MRGVAEVKEPCSLPMLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 84380 - protein, 102 aa, Homo sapiens; identical to SEQ ID NO: 84375
  Payload ID: 16785
  Gene Symbol: SAMD13
  Gene Name: sterile alpha motif domain containing 13
  Uniprot ID: Q5VXD3
  ENSP ID: ENSP00000378311

SEQ ID NO: 84381 - protein, 50 aa, Homo sapiens
  Payload ID: 16785
  Gene Symbol: SAMD13
  Gene Name: sterile alpha motif domain containing 13
  ENSP ID: ENSP00000391978
VMDVVNYFRTVGFEEQASAFQEQDKVTDRDKYLECTPIESWSGQIKGLLL

SEQ ID NO: 84382 - protein, 429 aa, Homo sapiens
  Payload ID: 16786
  Gene Symbol: SAMD14
  Gene Name: sterile alpha motif domain containing 14
  ENSP ID: ENSP00000285206
SRFPSGIPVEESGGVLSKGTWRNEGEDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 84383 - protein, 417 aa, Homo sapiens
  Payload ID: 16786
  Gene Symbol: SAMD14
  Gene Name: sterile alpha motif domain containing 14
  Uniprot ID: Q8IZD0
  ENSP ID: ENSP00000329144
MASSKLREPVDEVFDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 84384 - protein, 13 aa, Homo sapiens
  Payload ID: 16786
  Gene Symbol: SAMD14
  Gene Name: sterile alpha motif domain containing 14
  ENSP ID: ENSP00000423479
MASSKLREPVDEV

SEQ ID NO: 84385 - protein, 445 aa, Homo sapiens
  Payload ID: 16786
  Gene Symbol: SAMD14
  Gene Name: sterile alpha motif domain containing 14
  Uniprot ID: Q8IZD0
  ENSP ID: ENSP00000424474
MASSKLREPVDEVFDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQAQLLAHAQEALSNSWCLVQDFGSTQIGMESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 84386 - protein, 674 aa, Homo sapiens
  Payload ID: 16787
  Gene Symbol: SAMD15
  Gene Name: sterile alpha motif domain containing 15
  Uniprot ID: Q9P1V8
  ENSP ID: ENSP00000216471
MAEVPEDYDSGPDEDGELEPERPELPGLHKLYENAEPDTMAKADSKLPAEIYQEPQPETEEEDFKEGEPDSAKNVQLKPGGTSQEGIAKESKRDVPSETEPGIHQEVKSETSREMGEFFKDLEAPMDETHKESDLEPPEEAKPNVTEDVFLESAMETDPDPVPPTETMSEVSGATVRERNLELLEEETEPGVPEESLRVQHEETGLEPPEQTKQDFPSEKLGESLEETDLQPPKMTKPETPEETQRESTEKKRTEPPEQARLEFLEKEPRKSSEEAGLEPPEETQPEVPEEMQRKATEEKGTELPERTKPDFPDHKPRKSTDENVPEPLEEIKLEFPEEESRKTNEETILEQSEMMKPESPEEIRKSNEKKNPQPPEETGPVLPQEINPQVEEKTQTKPTEKILELPDETKPRETHVEFSKEDRPEPIKSKYSVGNDELEHREPKRGKLSLSDKFRKEYYALGSLRESEESIGTHYEFLQPLQKLLNVSEECSYSDPSESQTELSEFVHEKEVVDLSQELKERVSEDDETQPEKGTELQFEHLNWDPEEVAEWISQLGFPQYKECFITNFISGRKLIHVNCSNLPQMGITNFEDMKAISRHTQELLEIEEPLFKRSISLPYRDIIGLYLEQKGHTGIKSDSLTLSEFVKAAGLQDYAPEITAPEENEELPCTEP

SEQ ID NO: 84387 - protein, 88 aa, Homo sapiens
  Payload ID: 16787
  Gene Symbol: SAMD15
  Gene Name: sterile alpha motif domain containing 15
  ENSP ID: ENSP00000450941
MGITNFEDMKAISRHTQELLEIEEPLFKRSISLPYRDIIGLYLEQKGHTGIKSDSLTLSEFVKAAGLQDYAPEITAPEENEELPCTEP

SEQ ID NO: 84388 - protein, 221 aa, Homo sapiens
  Payload ID: 16788
  Gene Symbol: SAMD3
  Gene Name: sterile alpha motif domain containing 3
  Uniprot ID: Q8N6K7
  ENSP ID: ENSP00000324874
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFAGV

SEQ ID NO: 84389 - protein, 520 aa, Homo sapiens
  Payload ID: 16788
  Gene Symbol: SAMD3
  Gene Name: sterile alpha motif domain containing 3
  Uniprot ID: Q8N6K7
  ENSP ID: ENSP00000357116
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKEEAVCFDSELDEHIKWFQQEYVKTEKDWREIDKRMSQTLEIRRKMIGSRTPLKDILKLFPFLKCPYQMFREFQLLTRTDIYKKTRHILESYSENILTSFSVVDNPINIVLQEKMKHYTDEDMLKYMKMTATCLLLPDVFGDDPSLFVIMNEQVQVSTPVLEVKNPFNMEVCEFSLYLERERLTKVDDCVTALAALVAAFHVFRIECPRRLSQTFNFLETLIFDMHSPYFPSLKEKENEVGFQHPLT

SEQ ID NO: 84390 - protein, 520 aa, Homo sapiens; identical to SEQ ID NO: 84389
  Payload ID: 16788
  Gene Symbol: SAMD3
  Gene Name: sterile alpha motif domain containing 3
  Uniprot ID: Q8N6K7
  ENSP ID: ENSP00000391163

SEQ ID NO: 84391 - protein, 544 aa, Homo sapiens
  Payload ID: 16788
  Gene Symbol: SAMD3
  Gene Name: sterile alpha motif domain containing 3
  Uniprot ID: Q8N6K7
  ENSP ID: ENSP00000402092
MRSSKLQSPSPSQEKQGVYLQETAMETWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKEEAVCFDSELDEHIKWFQQEYVKTEKDWREIDKRMSQTLEIRRKMIGSRTPLKDILKLFPFLKCPYQMFREFQLLTRTDIYKKTRHILESYSENILTSFSVVDNPINIVLQEKMKHYTDEDMLKYMKMTATCLLLPDVFGDDPSLFVIMNEQVQVSTPVLEVKNPFNMEVCEFSLYLERERLTKVDDCVTALAALVAAFHVFRIECPRRLSQTFNFLETLIFDMHSPYFPSLKEKENEVGFQHPLT

SEQ ID NO: 84392 - protein, 520 aa, Homo sapiens; identical to SEQ ID NO: 84389
  Payload ID: 16788
  Gene Symbol: SAMD3
  Gene Name: sterile alpha motif domain containing 3
  Uniprot ID: Q8N6K7
  ENSP ID: ENSP00000403565

SEQ ID NO: 84393 - protein, 165 aa, Homo sapiens
  Payload ID: 16788
  Gene Symbol: SAMD3
  Gene Name: sterile alpha motif domain containing 3
  ENSP ID: ENSP00000434139
METWSVEQVCSWLVEKNLGELVHRFQEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRNVKQILARSKALQWTKSYVLPEFPYDVKCMLAEQKCPDH

SEQ ID NO: 84394 - protein, 173 aa, Homo sapiens
  Payload ID: 16788
  Gene Symbol: SAMD3
  Gene Name: sterile alpha motif domain containing 3
  ENSP ID: ENSP00000435875
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIR

SEQ ID NO: 84395 - protein, 77 aa, Homo sapiens
  Payload ID: 16788
  Gene Symbol: SAMD3
  Gene Name: sterile alpha motif domain containing 3
  ENSP ID: ENSP00000435879
  MOD_RES (1)..(1): Any amino acid
XFPFLKCPYQMFREFQLLTRTDIYKKTRHILESYSENILTSFSVVDNPINIVLQEKMKHYTDEDMLKCASVHTCVGS

SEQ ID NO: 84396 - protein, 275 aa, Homo sapiens
  Payload ID: 16788
  Gene Symbol: SAMD3
  Gene Name: sterile alpha motif domain containing 3
  ENSP ID: ENSP00000436088
METWSVEQVCSWLVEKNLGELVHRFQEEEVSGAALLALNDRMVQQLVKKIGHQAVLMDLIKKYKQNTQGLKSPENPKKAALVMQTEAAREDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKLSA

SEQ ID NO: 84397 - protein, 210 aa, Homo sapiens
  Payload ID: 16788
  Gene Symbol: SAMD3
  Gene Name: sterile alpha motif domain containing 3
  ENSP ID: ENSP00000436115
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRNVKQILARSKALQWTKSYVLPEFPYDVKCMLAEQKCPDHSMRIRIIEFLQADMTKYLEGSLYPSTQQYNDVVNALLQAHPFL

SEQ ID NO: 84398 - protein, 37 aa, Homo sapiens
  Payload ID: 16788
  Gene Symbol: SAMD3
  Gene Name: sterile alpha motif domain containing 3
  ENSP ID: ENSP00000436997
METWSVEQVCSWLVEKNLGELVHRFQGRSKWGRSSCT

SEQ ID NO: 84399 - protein, 630 aa, Homo sapiens
  Payload ID: 16789
  Gene Symbol: SAMD4A
  Gene Name: sterile alpha motif domain containing 4A
  Uniprot ID: Q9UPU9
  ENSP ID: ENSP00000251091
MMFRDQVGVLAGWFKGWNECEQTVALLSLLKRVSQTQARFLQLCLEHSLADCAELHVLEREANSPGIINQWQQESKDKVISLLLTHLPLLKPGNLDAKVEYMKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTNVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 84400 - protein, 718 aa, Homo sapiens
  Payload ID: 16789
  Gene Symbol: SAMD4A
  Gene Name: sterile alpha motif domain containing 4A
  Uniprot ID: Q9UPU9
  ENSP ID: ENSP00000375919
MMFRDQVGVLAGWFKGWNECEQTVALLSLLKRVSQTQARFLQLCLEHSLADCAELHVLEREANSPGIINQWQQESKDKVISLLLTHLPLLKPGNLDAKVEYMKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTILSGQAHHSPLKRSVSLTPPMNVPNQPLGHGWMSHEDLRARGPQCLPSDHAPLSPQSSVASSGSGGSEHLEDQTTARNTFQEEGSGMKDVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 84401 - protein, 345 aa, Homo sapiens
  Payload ID: 16789
  Gene Symbol: SAMD4A
  Gene Name: sterile alpha motif domain containing 4A
  ENSP ID: ENSP00000450808
MILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGEFQLPVTEPDINNRLESLCLSMTEHALGDGVDRTSTI

SEQ ID NO: 84402 - protein, 718 aa, Homo sapiens; identical to SEQ ID NO: 84400
  Payload ID: 16789
  Gene Symbol: SAMD4A
  Gene Name: sterile alpha motif domain containing 4A
  Uniprot ID: Q9UPU9
  ENSP ID: ENSP00000452535

SEQ ID NO: 84403 - protein, 345 aa, Homo sapiens; identical to SEQ ID NO: 84401
  Payload ID: 16789
  Gene Symbol: SAMD4A
  Gene Name: sterile alpha motif domain containing 4A
  ENSP ID: ENSP00000486821

SEQ ID NO: 84404 - protein, 694 aa, Homo sapiens
  Payload ID: 16790
  Gene Symbol: SAMD4B
  Gene Name: sterile alpha motif domain containing 4B
  Uniprot ID: Q5PRF9
  ENSP ID: ENSP00000317224
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTSPSLGGQGRQNLWFANPGGSNSMPSQSRSSVQRTHSLPVHSSPQAILMFPPDCPVPGPDLEINPTLESLCLSMTEHALGDGTDKTSTI

SEQ ID NO: 84405 - protein, 94 aa, Homo sapiens
  Payload ID: 16790
  Gene Symbol: SAMD4B
  Gene Name: sterile alpha motif domain containing 4B
  ENSP ID: ENSP00000468891
  MOD_RES (1)..(1): Any amino acid
XSPRHALTSPSLGGQGRQNLWFANPGGSNSMPSQSRSSVQRTHSLPVHSSPQAILMFPPDCPVPGPDLEINPTLESLCLSMTEHALGGEHFLFP

SEQ ID NO: 84406 - protein, 75 aa, Homo sapiens
  Payload ID: 16790
  Gene Symbol: SAMD4B
  Gene Name: sterile alpha motif domain containing 4B
  ENSP ID: ENSP00000469404
MMFRDQVGILAGWFKGWNECEQTVALLSLLKRVTRTQARFLQLCLEHSLADCNDIHLLESEANSAAIVSQWQQES

SEQ ID NO: 84407 - protein, 219 aa, Homo sapiens
  Payload ID: 16790
  Gene Symbol: SAMD4B
  Gene Name: sterile alpha motif domain containing 4B
  ENSP ID: ENSP00000469620
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSN

SEQ ID NO: 84408 - protein, 692 aa, Homo sapiens
  Payload ID: 16790
  Gene Symbol: SAMD4B
  Gene Name: sterile alpha motif domain containing 4B
  ENSP ID: ENSP00000470237
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTSPSLGGQGRQNLWFANPGGSNSMPSQSRSSVQRTHSLPVHSSPQAILMFPPDCPVPGPDLEINPTLESLCLSMTEHALGGPSRDLC

SEQ ID NO: 84409 - protein, 48 aa, Homo sapiens
  Payload ID: 16790
  Gene Symbol: SAMD4B
  Gene Name: sterile alpha motif domain containing 4B
  ENSP ID: ENSP00000470821
AINSIGSNANTDVPSWLKSLRLHKYAALFSQMSYEEMMTLTEQHLESQ

SEQ ID NO: 84410 - protein, 325 aa, Homo sapiens
  Payload ID: 16790
  Gene Symbol: SAMD4B
  Gene Name: sterile alpha motif domain containing 4B
  ENSP ID: ENSP00000471509
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQNQL

SEQ ID NO: 84411 - protein, 663 aa, Homo sapiens
  Payload ID: 16790
  Gene Symbol: SAMD4B
  Gene Name: sterile alpha motif domain containing 4B
  ENSP ID: ENSP00000478730
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGVSPLTCPHQPQPWRPGPTEPVVCQPWRQQQHAQSEPQLCAAHPLAPGPLVTPGHSHVPSRLPGSWA

SEQ ID NO: 84412 - protein, 663 aa, Homo sapiens
  Payload ID: 16790
  Gene Symbol: SAMD4B
  Gene Name: sterile alpha motif domain containing 4B
  ENSP ID: ENSP00000482861
MMFRDQVGILAGWFKGWNECEQTVALLSLLKRVTRTQARFLQLCLEHSLADCNDIHLLESEANSAAIVSQWQQESKEKVVSLLLSHLPLLQPGNTEAKSEYMRLLQKVLAYSIESNAFIEESRQLLSYALIHPATTLEDRNALALWLSHLEERLASGFRSRPEPSYHSRQGSDEWGGPAELGPGEAGPGWQDKPPRENGHVPFHPSSSVPPAINSIGSNANTGLPCQIHPSPLKRSMSLIPTSPQVPGEWPSPEELGARAAFTTPDHAPLSPQSSVASSGSEQTEEQGSSRNTFQEDGSGMKDVPSWLKSLRLHKYAALFSQMSYEEMMTLTEQHLESQNVTKGARHKIALSIQKLRERQSVLKSLEKDVLEGGNLRNALQELQQIIITPIKAYSVLQATVAAATTTPTAKDGAPGEPPLPGAEPPLAHPGTDKGTEAKDPPAVENYPPPPAPAPTDGSEPAPAPVADGDIPSQFTRVMGKVCTQLLVSRPDEENITSYLQLIEKCLTHEAFTETQKKRLLSWKQQVLKLLRTFPRKAALEMQNYRQQKGWAFGSNSLPIAGSVGMGVARRTQRQFPMPPRALPPGRMGLLSPSGIGGVSPRHALTPQPWRPGPTEPVVCQPWRQQQHAQSEPQLCAAHPLAPGPLVTPGHSHVPSRLPGSWA

SEQ ID NO: 84413 - protein, 694 aa, Homo sapiens; identical to SEQ ID NO: 84404
  Payload ID: 16790
  Gene Symbol: SAMD4B
  Gene Name: sterile alpha motif domain containing 4B
  Uniprot ID: Q5PRF9
  ENSP ID: ENSP00000484229

SEQ ID NO: 84414 - protein, 173 aa, Homo sapiens
  Payload ID: 16791
  Gene Symbol: SAMD5
  Gene Name: sterile alpha motif domain containing 5
  Uniprot ID: Q5TGI4
  ENSP ID: ENSP00000356444
MCTNIVYEWLKALQLPQYAESFVDNGYDDLEVCKQIGDPDLDAIGVLAPAHRRRILEAVRRLREQDANAAGLYFTLEPQPAPPGPPADAVPTGRRGEPCGGPAQGTRGDSRGHTTAPRSRELVSYPKLKLKIMIRDKLVRDGIHLSKPPYSRKVPMAGILEYLMNWPKSSQSR

SEQ ID NO: 84415 - protein, 97 aa, Homo sapiens
  Payload ID: 16791
  Gene Symbol: SAMD5
  Gene Name: sterile alpha motif domain containing 5
  ENSP ID: ENSP00000456528
GGPAQGTRGDSRGHTTAPRSRELVSYPKLKLKIMIRDKLVRDGIHLSKPPYSRKVLLCRYLQEVICVLFIGAVNLIISIPRYYRMTIRRCIDISLDT

SEQ ID NO: 84416 - protein, 446 aa, Homo sapiens
  Payload ID: 16792
  Gene Symbol: SAMD7
  Gene Name: sterile alpha motif domain containing 7
  Uniprot ID: Q7Z3H4
  ENSP ID: ENSP00000334668
MAVNPLLTPTGQQTIPLIPSPFGPPTVDRDVLPSTVAPTDPRQFCVPSQFGSSVLPNTNMANVLSSRIYPGWGILPPESIKAVARRNEMIQRHHTARTEMEMYAIYQQRRMEKINPKGLAGLGIPFLYGSSVPAAPAAYHGRSMLPAGDLHFHRSTLRNLQGNPMLAATAPHFEESWGQRCRRLRKNTGNQKALDSDAESSKSQAEEKILGQTHAVPYEEDHYAKDPDIEAPSNQKSSETNEKPTTALANTCGELEPTHRKPWGSHTTTLKAKAWDDGKEEASEQIFATCDEKNGVCPPVPRPSLPGTHALVTIGGNLSLDEDIQKWTVDDVHSFIRSLPGCSDYAQVFKDHAIDGETLPLLTEEHLRGTMGLKLGPALKIQSQVSQHVGSMFYKKTLSFPIRQAFDQPADTSPLLDPNSWSDTMNIFCPQDTIIPKGIERGSMRN

SEQ ID NO: 84417 - protein, 446 aa, Homo sapiens; identical to SEQ ID NO: 84416
  Payload ID: 16792
  Gene Symbol: SAMD7
  Gene Name: sterile alpha motif domain containing 7
  Uniprot ID: Q7Z3H4
  ENSP ID: ENSP00000391299

SEQ ID NO: 84418 - protein, 98 aa, Homo sapiens
  Payload ID: 16792
  Gene Symbol: SAMD7
  Gene Name: sterile alpha motif domain containing 7
  ENSP ID: ENSP00000420460
MAVNPLLTPTGQQTIPLIPSPFGPPTVDRDVLPSTVAPTDPRQFCVPSQFGSSVLPNTNMANVLSSRIYPGWGILPPESIKAVARRNEMIQRHHTARV

SEQ ID NO: 84419 - protein, 326 aa, Homo sapiens
  Payload ID: 16793
  Gene Symbol: SAMD8
  Gene Name: sterile alpha motif domain containing 8
  Uniprot ID: Q96LT4
  ENSP ID: ENSP00000361772
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTECKYLFSASMRIR

SEQ ID NO: 84420 - protein, 478 aa, Homo sapiens
  Payload ID: 16793
  Gene Symbol: SAMD8
  Gene Name: sterile alpha motif domain containing 8
  ENSP ID: ENSP00000361775
MPARSRHRPRLHSGSPPRAPPPPLEALHSGEAGRAPDSDGGSDADSEVGPGSPTRTAEAAEEEMAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTEYTPRSWNFLHTLSWVLNLFGIFFILAAHEHYSIDVFIAFYITTRLFLYYHTLANTRAYQQSRRARIWFPMFSFFECNVNGTVPNEYCWPFSKPAIMKRLIG

SEQ ID NO: 84421 - protein, 253 aa, Homo sapiens
  Payload ID: 16793
  Gene Symbol: SAMD8
  Gene Name: sterile alpha motif domain containing 8
  ENSP ID: ENSP00000391799
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLS

SEQ ID NO: 84422 - protein, 415 aa, Homo sapiens
  Payload ID: 16793
  Gene Symbol: SAMD8
  Gene Name: sterile alpha motif domain containing 8
  Uniprot ID: Q96LT4
  ENSP ID: ENSP00000438042
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTEYTPRSWNFLHTLSWVLNLFGIFFILAAHEHYSIDVFIAFYITTRLFLYYHTLANTRAYQQSRRARIWFPMFSFFECNVNGTVPNEYCWPFSKPAIMKRLIG

SEQ ID NO: 84423 - protein, 1589 aa, Homo sapiens
  Payload ID: 16794
  Gene Symbol: SAMD9
  Gene Name: sterile alpha motif domain containing 9
  Uniprot ID: Q5K651
  ENSP ID: ENSP00000369292
MAKQLNLPENTDDWTKEDVNQWLESHKIDQKHREILTEQDVNGAVLKWLKKEHLVDMGITHGPAIQIEELFKELRKTAIEDSIQTSKMGKPSKNAPKDQTVSQKERRETSKQKQKGKENPDMANPSAMSTTAKGSKSLKVELIEDKIDYTKERQPSIDLTCVSYPFDEFSNPYRYKLDFSLQPETGPGNLIDPIHEFKAFTNTATATEEDVKMKFSNEVFRFASACMNSRTNGTIHFGVKDKPHGKIVGIKVTNDTKEALINHFNLMINKYFEDHQVQQAKKCIREPRFVEVLLPNSTLSDRFVIEVDIIPQFSECQYDYFQIKMQNYNNKIWEQSKKFSLFVRDGTSSKDITKNKVDFRAFKADFKTLAESRKAAEEKFRAKTNKKEREGPKLVKLLTGNQDLLDNSYYEQYILVTNKCHPDQTKHLDFLKEIKWFAVLEFDPESNINGVVKAYKESRVANLHFPSVYVEQKTTPNETISTLNLYHQPSWIFCNGRLDLDSEKYKPFDPSSWQRERASDVRKLISFLTHEDIMPRGKFLVVFLLLSSVDDPRDPLIETFCAFYQDLKGMENILCICVHPHIFQGWKDLLEARLIKHQDEISSQCISALSLEEINGTILKLKSVTQSSKRLLPSIGLSTVLLKKEEDIMTALEIICENECEGTLLEKDKNKFLEFKASKEEDFYRGGKVSWWNFYFSSESYSSPFVKRDKYERLEAMIQNCADSSKPTSTKIIHLYHHPGCGGTTLAMHILWELRKKFRCAVLKNKTVDFSEIGEQVTSLITYGAMNRQEYVPVLLLVDDFEEQDNVYLLQYSIQTAIAKKYIRYEKPLVIILNCMRSQNPEKSARIPDSIAVIQQLSPKEQRAFELKLKEIKEQHKNFEDFYSFMIMKTNFNKEYIENVVRNILKGQNIFTKEAKLFSFLALLNSYVPDTTISLSQCEKFLGIGNKKAFWGTEKFEDKMGTYSTILIKTEVIECGNYCGVRIIHSLIAEFSLEELKKSYHLNKSQIMLDMLTENLFFDTGMGKSKFLQDMHTLLLTRHRDEHEGETGNWFSPFIEALHKDEGNEAVEAVLLESIHRFNPNAFICQALARHFYIKKKDFGNALNWAKQAKIIEPDNSYISDTLGQVYKSKIRWWIEENGGNGNISVDDLIALLDLAEHASSAFKESQQQSEDREYEVKERLYPKSKRRYDTYNIAGYQGEIEVGLYTIQILQLIPFFDNKNELSKRYMVNFVSGSSDIPGDPNNEYKLALKNYIPYLTKLKFSLKKSFDFFDEYFVLLKPRNNIKQNEEAKTRRKVAGYFKKYVDIFCLLEESQNNTGLGSKFSEPLQVERCRRNLVALKADKFSGLLEYLIKSQEDAISTMKCIVNEYTFLLEQCTVKIQSKEKLNFILANIILSCIQPTSRLVKPVEKLKDQLREVLQPIGLTYQFSEPYFLASLLFWPENQQLDQHSEQMKEYAQALKNSFKGQYKHMHRTKQPIAYFFLGKGKRLERLVHKGKIDQCFKKTPDINSLWQSGDVWKEEKVQELLLRLQGRAENNCLYIEYGINEKITIPITPAFLGQLRSGRSIEKVSFYLGFSIGGPLAYDIEIV

SEQ ID NO: 84424 - protein, 1283 aa, Homo sapiens
  Payload ID: 16794
  Gene Symbol: SAMD9
  Gene Name: sterile alpha motif domain containing 9
  ENSP ID: ENSP00000414529
MAKQLNLPENTDDWTKEDVNQWLESHKIDQKHREILTEQDVNGAVLKWLKKEHLVDMGITHGPAIQIEELFKELRKTAIEDSIQTSKMGKPSKNAPKDQTVSQKERRETSKQKQKGKENPDMANPSAMSTTAKGSKSLKVELIEDKIDYTKERQPSIDLTCVSYPFDEFSNPYRYKLDFSLQPETGPGNLIDPIHEFKAFTNTATATEEDVKMKFSNEVFRFASACMNSRTNGTIHFGVKDKPHGKIVGIKVTNDTKEALINHFNLMINKYFEDHQVQQAKKCIREPRFVEVLLPNSTLSDRFVIEVDIIPQFSECQYDYFQIKMQNYNNKIWEQSKKFSLFVRDGTSSKDITKNKVDFRAFKADFKTLAESRKAAEEKFRAKTNKKEREGPKLVKLLTGNQDLLDNSYYEQYILVTNKCHPDQTKHLDFLKEIKWFAVLEFDPESNINGVVKAYKESRVANLHFPSVYVEQKTTPNETISTLNLYHQPSWIFCNGRLDLDSEKYKPFDPSSWQRERASDVRKLISFLTHEDIMPRGKFLVVFLLLSSVDDPRDPLIETFCAFYQDLKGMENILCICVHPHIFQGWKDLLEARLIKHQDEISSQCISALSLEEINGTILKLKSVTQSSKRLLPSIGLSTVLLKKEEDIMTALEIICENECEGTLLEKDKNKFLEFKASKEEDFYRGGKVSWWNFYFSSESYSSPFVKRDKYERLEAMIQNCADSSKPTSTKIIHLYHHPGCGGTTLAMHILWELRKKFRCAVLKNKTVDFSEIGEQVTSLITYGAMNRQEYVPVLLLVDDFEEQDNVYLLQYSIQTAIAKKYIRYEKPLVIILNCMRSQNPEKSARIPDSIAVIQQLSPKEQRAFELKLKEIKEQHKNFEDFYSFMIMKTNFNKEYIENVVRNILKGQNIFTKEAKLFSFLALLNSYVPDTTISLSQCEKFLGIGNKKAFWGTEKFEDKMGTYSTILIKTEVIECGNYCGVRIIHSLIAEFSLEELKKSYHLNKSQIMLDMLTENLFFDTGMGKSKFLQDMHTLLLTRHRDEHEGETGNWFSPFIEALHKDEGNEAVEAVLLESIHRFNPNAFICQALARHFYIKKKDFGNALNWAKQAKIIEPDNSYISDTLGQVYKSKIRWWIEENGGNGNISVDDLIALLDLAEHASSAFKESQQQSEDREYEVKERLYPKSKRRYDTYNIAGYQGEIEVGLYTIQILQLIPFFDNKNELSKRYMVNFVSGSSDIPGDPNNEYKLALKNYIPYLTKLKFSLKKSFDFFDEYFVLLKPRNN

SEQ ID NO: 84425 - protein, 1589 aa, Homo sapiens; identical to SEQ ID NO: 84423
  Payload ID: 16794
  Gene Symbol: SAMD9
  Gene Name: sterile alpha motif domain containing 9
  Uniprot ID: Q5K651
  ENSP ID: ENSP00000484636

SEQ ID NO: 84426 - protein, 1584 aa, Homo sapiens
  Payload ID: 16795
  Gene Symbol: SAMD9L
  Gene Name: sterile alpha motif domain containing 9-like
  Uniprot ID: Q8IVG5
  ENSP ID: ENSP00000326247
MSKQVSLPEMIKDWTKEHVKKWVNEDLKINEQYGQILLSEEVTGLVLQELTEKDLVEMGLPWGPALLIKRSYNKLNSKSPESDNHDPGQLDNSKPSKTEHQKNPKHTKKEEENSMSSNIDYDPREIRDIKQEESILMKENVLDEVANAKHKKKGKLKPEQLTCMPYPFDQFHDSHRYIEHYTLQPETGALNLIDPIHEFKALTNTETATEVDIKMKFSNEVFRFASACMNSRTNGTIHFGVKDKPHGEIVGVKITSKAAFIDHFNVMIKKYFEESEINEAKKCIREPRFVEVLLQNNTPSDRFVIEVDTIPKHSICNDKYFYIQMQICKDKIWKQNQNLSLFVREGASSRDILANSKQRDVDFKAFLQNLKSLVASRKEAEEEYGMKAMKKESEGLKLVKLLIGNRDSLDNSYYDWYILVTNKCHPNQIKHLDFLKEIKWFAVLEFDPESMINGVVKAYKESRVANLHFPNQYEDKTTNMWEKISTLNLYQQPSWIFCNGRSDLKSETYKPLEPHLWQRERASEVRKLILFLTDENIMTRGKFLVVFLLLSSVESPGDPLIETFWAFYQALKGMENMLCISVNSHIYQRWKDLLQTRMKMEDELTNHSISTLNIELVNSTILKLKSVTRSSRRFLPARGSSSVILEKKKEDVLTALEILCENECTETDIEKDKSKFLEFKKSKEEHFYRGGKVSWWNFYFSSENYSSDFVKRDSYEKLKDLIHCWAESPKPIFAKIINLYHHPGCGGTTLAMHVLWDLKKNFRCAVLKNKTTDFAEIAEQVINLVTYRAKSHQDYIPVLLLVDDFEEQENVYFLQNAIHSVLAEKDLRYEKTLVIILNCMRSRNPDESAKLADSIALNYQLSSKEQRAFGAKLKEIEKQHKNCENFYSFMIMKSNFDETYIENVVRNILKGQDVDSKEAQLISFLALLSSYVTDSTISVSQCEIFLGIIYTSTPWEPESLEDKMGTYSTLLIKTEVAEYGRYTGVRIIHPLIALYCLKELERSYHLDKCQIALNILEENLFYDSGIGRDKFQHDVQTLLLTRQRKVYGDETDTLFSPLMEALQNKDIEKVLSAGSRRFPQNAFICQALARHFYIKEKDFNTALDWARQAKMKAPKNSYISDTLGQVYKSEIKWWLDGNKNCRSITVNDLTHLLEAAEKASRAFKESQRQTDSKNYETENWSPQKSQRRYDMYNTACFLGEIEVGLYTIQILQLTPFFHKENELSKKHMVQFLSGKWTIPPDPRNECYLALSKFTSHLKNLQSDLKRCFDFFIDYMVLLKMRYTQKEIAEIMLSKKVSRCFRKYTELFCHLDPCLLQSKESQLLQEENCRKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 84427 - protein, 69 aa, Homo sapiens
  Payload ID: 16795
  Gene Symbol: SAMD9L
  Gene Name: sterile alpha motif domain containing 9-like
  ENSP ID: ENSP00000391387
MSKQVSLPEMIKDWTKEHVKKWVNEDLKINEQYGQILLSEEVTGLVLQELTEKDLVEMGLPWGPALLIK

SEQ ID NO: 84428 - protein, 69 aa, Homo sapiens; identical to SEQ ID NO: 84427
  Payload ID: 16795
  Gene Symbol: SAMD9L
  Gene Name: sterile alpha motif domain containing 9-like
  ENSP ID: ENSP00000391699

SEQ ID NO: 84429 - protein, 69 aa, Homo sapiens; identical to SEQ ID NO: 84427
  Payload ID: 16795
  Gene Symbol: SAMD9L
  Gene Name: sterile alpha motif domain containing 9-like
  ENSP ID: ENSP00000396137

SEQ ID NO: 84430 - protein, 1584 aa, Homo sapiens; identical to SEQ ID NO: 84426
  Payload ID: 16795
  Gene Symbol: SAMD9L
  Gene Name: sterile alpha motif domain containing 9-like
  Uniprot ID: Q8IVG5
  ENSP ID: ENSP00000405760

SEQ ID NO: 84431 - protein, 1584 aa, Homo sapiens; identical to SEQ ID NO: 84426
  Payload ID: 16795
  Gene Symbol: SAMD9L
  Gene Name: sterile alpha motif domain containing 9-like
  Uniprot ID: Q8IVG5
  ENSP ID: ENSP00000408796

SEQ ID NO: 84432 - protein, 69 aa, Homo sapiens; identical to SEQ ID NO: 84427
  Payload ID: 16795
  Gene Symbol: SAMD9L
  Gene Name: sterile alpha motif domain containing 9-like
  ENSP ID: ENSP00000410062

SEQ ID NO: 84433 - protein, 406 aa, Homo sapiens
  Payload ID: 16795
  Gene Symbol: SAMD9L
  Gene Name: sterile alpha motif domain containing 9-like
  Uniprot ID: Q8IVG5
  ENSP ID: ENSP00000484397
MSKQVSLPEMIKDWTKEHVKKWVNEDLKINEQYGQILLSEEVTGLVLQELTEKDLVEMGLPWGPALLIKRSYNKLNSKSPESDNHDPGQLDNSKPSKTEHQKNPKHTKKEEENSMSSNIDYDPREIRDIKQEESILMKENVLDEVANAKHKKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 84434 - protein, 318 aa, Homo sapiens
  Payload ID: 16796
  Gene Symbol: SRD5A3
  Gene Name: steroid 5 alpha-reductase 3
  Uniprot ID: Q9H8P0
  ENSP ID: ENSP00000264228
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKCHVILGNLRKNKAGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 84435 - protein, 182 aa, Homo sapiens
  Payload ID: 16796
  Gene Symbol: SRD5A3
  Gene Name: steroid 5 alpha-reductase 3
  ENSP ID: ENSP00000424714
FLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 84436 - protein, 236 aa, Homo sapiens
  Payload ID: 16797
  Gene Symbol: SRA1
  Gene Name: steroid receptor RNA activator 1
  Uniprot ID: Q9HD15
  ENSP ID: ENSP00000337513
MTRCPAGQAEVEMAELYVKPGNKERGWNDPPQFSYGLQTQAGGPRRSLLTKRVAAPQDGSPRVPASETSPGPPPMGPPPPSSKAPRSPPVGSGPASGVEPTSFPVESEAVMEDVLRPLEQALEDCRGHTRKQVCDDISRRLALLQEQWAGGKLSIPVKKRMALLVQELSSHRWDAADDIHRSLMVDHVTEVSQWMVGVKRLIAEKRSLFSEEAANEEKSAATAEKNHTIPGFQQAS

SEQ ID NO: 84437 - protein, 75 aa, Homo sapiens
  Payload ID: 16797
  Gene Symbol: SRA1
  Gene Name: steroid receptor RNA activator 1
  ENSP ID: ENSP00000473378
  MOD_RES (1)..(1): Any amino acid
XQEQWAGGKLSIPVKKRMALLVQELSSHRWDAADDIHRSLMVDHVTEELSFNGKPTAYLRYPSRERARQLYLTQH

SEQ ID NO: 84438 - protein, 583 aa, Homo sapiens
  Payload ID: 16798
  Gene Symbol: STS
  Gene Name: steroid sulfatase (microsomal), isozyme S
  Uniprot ID: P08842
  ENSP ID: ENSP00000217961
MPLRKMKIPFLLLFFLWEAESHAASRPNIILVMADDLGIGDPGCYGNKTIRTPNIDRLASGGVKLTQHLAASPLCTPSRAAFMTGRYPVRSGMASWSRTGVFLFTASSGGLPTDEITFAKLLKDQGYSTALIGKWHLGMSCHSKTDFCHHPLHHGFNYFYGISLTNLRDCKPGEGSVFTTGFKRLVFLPLQIVGVTLLTLAALNCLGLLHVPLGVFFSLLFLAALILTLFLGFLHYFRPLNCFMMRNYEIIQQPMSYDNLTQRLTVEAAQFIQRNTETPFLLVLSYLHVHTALFSSKDFAGKSQHGVYGDAVEEMDWSVGQILNLLDELRLANDTLIYFTSDQGAHVEEVSSKGEIHGGSNGIYKGGKANNWEGGIRVPGILRWPRVIQAGQKIDEPTSNMDIFPTVAKLAGAPLPEDRIIDGRDLMPLLEGKSQRSDHEFLFHYCNAYLNAVRWHPQNSTSIWKAFFFTPNFNPVGSNGCFATHVCFCFGSYVTHHDPPLLFDISKDPRERNPLTPASEPRFYEILKVMQEAADRHTQTLPEVPDQFSWNNFLWKPWLQLCCPSTGLSCQCDREKQDKRLSR

SEQ ID NO: 84439 - protein, 259 aa, Homo sapiens
  Payload ID: 16799
  Gene Symbol: SRD5A1
  Gene Name: steroid-5-alpha-reductase, alpha polypeptide 1 (3-oxo-5 alpha-steroid delta 4-dehydrogenase alpha 1)
  Uniprot ID: P18405
  ENSP ID: ENSP00000274192
MATATGVAEERLLAALAYLQCAVGCAVFARNRQTNSVYGRHALPSHRLRVPARAAWVVQELPSLALPLYQYASESAPRLRSAPNCILLAMFLVHYGHRCLIYPFLMRGGKPMPLLACTMAIMFCTCNGYLQSRYLSHCAVYADDWVTDPRFLIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 84440 - protein, 135 aa, Homo sapiens
  Payload ID: 16799
  Gene Symbol: SRD5A1
  Gene Name: steroid-5-alpha-reductase, alpha polypeptide 1 (3-oxo-5 alpha-steroid delta 4-dehydrogenase alpha 1)
  ENSP ID: ENSP00000421342
MATATGVAEERLLAALAYLQCAVGCAVFARNRQTNSVYGRHALPSHRLRVPARAAWVVQELPSLALPLYQYASESAPRLRSAPNCILLAMFLVHYGHRFWLVVNGHVDKHPFRSYPKESQKTRRYWIQNTKGRLI

SEQ ID NO: 84441 - protein, 126 aa, Homo sapiens
  Payload ID: 16799
  Gene Symbol: SRD5A1
  Gene Name: steroid-5-alpha-reductase, alpha polypeptide 1 (3-oxo-5 alpha-steroid delta 4-dehydrogenase alpha 1)
  ENSP ID: ENSP00000425330
MATATGVAEERLLAALAYLQCAVGCAVFARNRQTNSVYGRHALPSHRLRVPARAAWVVQELPSLALPLYQYASESAPRLRSAPNCILLAMFLVHYGHRKCWYASTCSVPTSQMPAHGTHCLPGSES

SEQ ID NO: 84442 - protein, 254 aa, Homo sapiens
  Payload ID: 16800
  Gene Symbol: SRD5A2
  Gene Name: steroid-5-alpha-reductase, alpha polypeptide 2 (3-oxo-5 alpha-steroid delta 4-dehydrogenase alpha 2)
  Uniprot ID: P31213
  ENSP ID: ENSP00000477587
MQVQCQQSPVLAGSATLVALGALALYVAKPSGYGKHTESLKPAATRLPARAAWFLQELPSFAVPAGILARQPLSLFGPPGTVLLGLFCLHYFHRTFVYSLLNRGRPYPAILILRGTAFCTGNGVLQGYYLIYCAEYPDGWYTDIRFSLGVFLFILGMGINIHSDYILRQLRKPGEISYRIPQGGLFTYVSGANFLGEIIEWIGYALATWSLPALAFAFFSLCFLGLRAFHHHRFYLKMFEDYPKSRKALIPFIF

SEQ ID NO: 84443 - protein, 285 aa, Homo sapiens
  Payload ID: 16801
  Gene Symbol: STAR
  Gene Name: steroidogenic acute regulatory protein
  Uniprot ID: P49675
  ENSP ID: ENSP00000276449
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAAGNLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 84444 - protein, 249 aa, Homo sapiens
  Payload ID: 16801
  Gene Symbol: STAR
  Gene Name: steroidogenic acute regulatory protein
  ENSP ID: ENSP00000429009
  MOD_RES (1)..(1): Any amino acid
XLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAAGNLVGPRDFVSVRCAKRRGSTCVLAGMATDFGNMPEQKGVIRGGCPRASSTRSCPRPRWILPTTCASAWSPTLPLKPGVEDQPAVPNCAQLHWYT

SEQ ID NO: 84445 - protein, 48 aa, Homo sapiens
  Payload ID: 16801
  Gene Symbol: STAR
  Gene Name: steroidogenic acute regulatory protein
  ENSP ID: ENSP00000430030
MQKALGILSNQEGWKKESQQDNGDKVMSKVVPDVGKVFRLEVVVDQPM

SEQ ID NO: 84446 - protein, 503 aa, Homo sapiens
  Payload ID: 16802
  Gene Symbol: SCP2
  Gene Name: sterol carrier protein 2
  Uniprot ID: P22307
  ENSP ID: ENSP00000360564
MSSSPWEPATLRRVFVVGVGMTKFVKPGAENSRDYPDLAEEAGKKALADAQIPYSAVDQACVGYVFGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 84447 - protein, 322 aa, Homo sapiens
  Payload ID: 16802
  Gene Symbol: SCP2
  Gene Name: sterol carrier protein 2
  Uniprot ID: P22307
  ENSP ID: ENSP00000360568
MSSSPWEPATLRRVFVVGVGMTKFVKPGAENSRDYPDLAEEAGKKALADAQIPYSAVDQACVGYVFGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGGHSCS

SEQ ID NO: 84448 - protein, 547 aa, Homo sapiens
  Payload ID: 16802
  Gene Symbol: SCP2
  Gene Name: sterol carrier protein 2
  Uniprot ID: P22307
  ENSP ID: ENSP00000360569
MSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 84449 - protein, 523 aa, Homo sapiens
  Payload ID: 16802
  Gene Symbol: SCP2
  Gene Name: sterol carrier protein 2
  Uniprot ID: P22307
  ENSP ID: ENSP00000384569
MSSSPWEPATLRRVFVVGVGMTKFVKPGAENSRDYPDLAEEAGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 84450 - protein, 59 aa, Homo sapiens
  Payload ID: 16802
  Gene Symbol: SCP2
  Gene Name: sterol carrier protein 2
  Uniprot ID: P22307
  ENSP ID: ENSP00000386214
MGFPEAASSFRTHQIEAVPTSSASDGFKANLVFKEIEKKLEEIRRLTAQSQWLTQTSWL

SEQ ID NO: 84451 - protein, 143 aa, Homo sapiens
  Payload ID: 16802
  Gene Symbol: SCP2
  Gene Name: sterol carrier protein 2
  Uniprot ID: P22307
  ENSP ID: ENSP00000396413
MGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 84452 - protein, 140 aa, Homo sapiens
  Payload ID: 16802
  Gene Symbol: SCP2
  Gene Name: sterol carrier protein 2
  Uniprot ID: P22307
  ENSP ID: ENSP00000406636
MGFPEAARTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 84453 - protein, 240 aa, Homo sapiens
  Payload ID: 16802
  Gene Symbol: SCP2
  Gene Name: sterol carrier protein 2
  ENSP ID: ENSP00000431279
  MOD_RES (1)..(1): Any amino acid
XPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPPTSDGAAAAILASEAFVQKYGLQSKAVEILAQEMMTDLPSSFEEKSIIKMVGFDMSKEAARKCYEKSGL

SEQ ID NO: 84454 - protein, 78 aa, Homo sapiens
  Payload ID: 16802
  Gene Symbol: SCP2
  Gene Name: sterol carrier protein 2
  ENSP ID: ENSP00000432645
  MOD_RES (1)..(1): Any amino acid
XALQHNLGIGGAVVVTLYKMGFPEAASSFRTHQIEAVPTSSASDGFKANLVFKEIEKKLEEIRRLTAQSQWLTQTSWL

SEQ ID NO: 84455 - protein, 466 aa, Homo sapiens
  Payload ID: 16802
  Gene Symbol: SCP2
  Gene Name: sterol carrier protein 2
  Uniprot ID: P22307
  ENSP ID: ENSP00000434132
MTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 84456 - protein, 366 aa, Homo sapiens
  Payload ID: 16802
  Gene Symbol: SCP2
  Gene Name: sterol carrier protein 2
  ENSP ID: ENSP00000435194
MSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGGHSCS

SEQ ID NO: 84457 - protein, 59 aa, Homo sapiens; identical to SEQ ID NO: 84450
  Payload ID: 16802
  Gene Symbol: SCP2
  Gene Name: sterol carrier protein 2
  Uniprot ID: P22307
  ENSP ID: ENSP00000435783

SEQ ID NO: 84458 - protein, 32 aa, Homo sapiens
  Payload ID: 16802
  Gene Symbol: SCP2
  Gene Name: sterol carrier protein 2
  ENSP ID: ENSP00000436581
  MOD_RES (1)..(1): Any amino acid
XALQHNLGIGGAVVVTLYKMGFPEAARKGNSL

SEQ ID NO: 84459 - protein, 140 aa, Homo sapiens
  Payload ID: 16802
  Gene Symbol: SCP2
  Gene Name: sterol carrier protein 2
  ENSP ID: ENSP00000437317
  MOD_RES (1)..(1): Any amino acid
XALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSVSMMELISC

SEQ ID NO: 84460 - protein, 550 aa, Homo sapiens
  Payload ID: 16803
  Gene Symbol: SOAT1
  Gene Name: sterol O-acyltransferase 1
  Uniprot ID: P35610
  ENSP ID: ENSP00000356591
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 84461 - protein, 260 aa, Homo sapiens
  Payload ID: 16803
  Gene Symbol: SOAT1
  Gene Name: sterol O-acyltransferase 1
  ENSP ID: ENSP00000411309
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQ

SEQ ID NO: 84462 - protein, 485 aa, Homo sapiens
  Payload ID: 16803
  Gene Symbol: SOAT1
  Gene Name: sterol O-acyltransferase 1
  Uniprot ID: P35610
  ENSP ID: ENSP00000441356
MKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 84463 - protein, 492 aa, Homo sapiens
  Payload ID: 16803
  Gene Symbol: SOAT1
  Gene Name: sterol O-acyltransferase 1
  Uniprot ID: P35610
  ENSP ID: ENSP00000445315
MELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 84464 - protein, 522 aa, Homo sapiens
  Payload ID: 16804
  Gene Symbol: SOAT2
  Gene Name: sterol O-acyltransferase 2
  Uniprot ID: O75908
  ENSP ID: ENSP00000301466
MEPGGARLRLQRTEGLGGERERQPCGDGNTETHRAPDLVQWTRHMEAVKAQLLEQAQGQLRELLDRAMREAIQSYPSQDKPLPPPPPGSLSRTQEPSLGKQKVFIIRKSLLDELMEVQHFRTIYHMFIAGLCVFIISTLAIDFIDEGRLLLEFDLLIFSFGQLPLALVTWVPMFLSTLLAPYQALRLWARGTWTQATGLGCALLAAHAVVLCALPVHVAVEHQLPPASRCVLVFEQVRFLMKSYSFLREAVPGTLRARRGEGIQAPSFSSYLYFLFCPTLIYRETYPRTPYVRWNYVAKNFAQALGCVLYACFILGRLCVPVFANMSREPFSTRALVLSILHATLPGIFMLLLIFFAFLHCWLNAFAEMLRFGDRMFYRDWWNSTSFSNYYRTWNVVVHDWLYSYVYQDGLRLLGARARGVAMLGVFLVSAVAHEYIFCFVLGFFYPVMLILFLVIGGMLNFMMHDQRTGPAWNVLMWTMLFLGQGIQVSLYCQEWYARRHCPLPQATFWGLVTPRSWSCHT

SEQ ID NO: 84465 - protein, 310 aa, Homo sapiens
  Payload ID: 16804
  Gene Symbol: SOAT2
  Gene Name: sterol O-acyltransferase 2
  Uniprot ID: O75908
  ENSP ID: ENSP00000442234
MEPGGARLRLQRTEGLGGERERQPCGDGNTETHRAPDLVQWTRHMEAVKAQLLEQAQGQLRELLDRAMREAIQSYPSQDKPLPPPPPGSLSRTQEPSLGKQKVFIIRKSLLDELMEVQHFRTIYHMFIAGLCVFIISTLAIDFIDEGRLLLEFDLLIFSFGQLPLALVTWVPMFLSTLLAPYQALRLWARGTWTQATGLGCALLAAHAVVLCALPVHVAVEHQLPPASRCVLVFEQVRFLMKSYSFLREAVPGTLRARRGEGIQAPSFSSYLYFLFCPTLIYRETYPRPWDVCSMPASSWAASVFLSLPT

SEQ ID NO: 84466 - protein, 170 aa, Homo sapiens
  Payload ID: 16804
  Gene Symbol: SOAT2
  Gene Name: sterol O-acyltransferase 2
  ENSP ID: ENSP00000450120
MEPGGARLRLQRTEGLGGERERQPCGDGNTETHRAPDLVQWTRHMEAVKAQLLEQAQGQLRELLDRAMREAIQSYPSQDKPLPPPPPGSLSSELMEVQHFRTIYHMFIAGLCVFIISTLAIDFIDEGRLLLEFDLLIFSFGQLPLALVTWVPMFLSTLLAPYQALRLWAR

SEQ ID NO: 84467 - protein, 1147 aa, Homo sapiens
  Payload ID: 16805
  Gene Symbol: SREBF1
  Gene Name: sterol regulatory element binding transcription factor 1
  Uniprot ID: P36956
  ENSP ID: ENSP00000261646
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 84468 - protein, 1177 aa, Homo sapiens
  Payload ID: 16805
  Gene Symbol: SREBF1
  Gene Name: sterol regulatory element binding transcription factor 1
  Uniprot ID: P36956
  ENSP ID: ENSP00000348069
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 84469 - protein, 216 aa, Homo sapiens
  Payload ID: 16805
  Gene Symbol: SREBF1
  Gene Name: sterol regulatory element binding transcription factor 1
  ENSP ID: ENSP00000379100
MKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKTE

SEQ ID NO: 84470 - protein, 893 aa, Homo sapiens
  Payload ID: 16805
  Gene Symbol: SREBF1
  Gene Name: sterol regulatory element binding transcription factor 1
  ENSP ID: ENSP00000379106
MKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 84471 - protein, 325 aa, Homo sapiens
  Payload ID: 16805
  Gene Symbol: SREBF1
  Gene Name: sterol regulatory element binding transcription factor 1
  ENSP ID: ENSP00000411516
MDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVV

SEQ ID NO: 84472 - protein, 66 aa, Homo sapiens
  Payload ID: 16805
  Gene Symbol: SREBF1
  Gene Name: sterol regulatory element binding transcription factor 1
  ENSP ID: ENSP00000463474
MKTDGATVKAAGLSPLVSGTTVQTGPLPTLVSGGTILATVPLVVDAEKLPINRLAAGSKAPASAQS

SEQ ID NO: 84473 - protein, 163 aa, Homo sapiens
  Payload ID: 16805
  Gene Symbol: SREBF1
  Gene Name: sterol regulatory element binding transcription factor 1
  ENSP ID: ENSP00000464923
GCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGEGAAADQGCAVCSAGKGAHGM

SEQ ID NO: 84474 - protein, 31 aa, Homo sapiens
  Payload ID: 16805
  Gene Symbol: SREBF1
  Gene Name: sterol regulatory element binding transcription factor 1
  ENSP ID: ENSP00000465747
  MOD_RES (1)..(1): Any amino acid
XASPTRTHQLLDRSLRRRAGPGGKGADGCAD

SEQ ID NO: 84475 - protein, 157 aa, Homo sapiens
  Payload ID: 16805
  Gene Symbol: SREBF1
  Gene Name: sterol regulatory element binding transcription factor 1
  ENSP ID: ENSP00000466453
KAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRARWRSWSRGPRGGSTRRPCCWPPATCPPASCRRPGSAWACWLRRRA

SEQ ID NO: 84476 - protein, 110 aa, Homo sapiens
  Payload ID: 16805
  Gene Symbol: SREBF1
  Gene Name: sterol regulatory element binding transcription factor 1
  ENSP ID: ENSP00000466643
AVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGADGCAD

SEQ ID NO: 84477 - protein, 113 aa, Homo sapiens
  Payload ID: 16805
  Gene Symbol: SREBF1
  Gene Name: sterol regulatory element binding transcription factor 1
  ENSP ID: ENSP00000474121
  MOD_RES (1)..(1): Any amino acid
XLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKVGPCHGAPFPTPSHIL

SEQ ID NO: 84478 - protein, 1141 aa, Homo sapiens
  Payload ID: 16806
  Gene Symbol: SREBF2
  Gene Name: sterol regulatory element binding transcription factor 2
  Uniprot ID: Q12772
  ENSP ID: ENSP00000354476
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 84479 - protein, 684 aa, Homo sapiens
  Payload ID: 16806
  Gene Symbol: SREBF2
  Gene Name: sterol regulatory element binding transcription factor 2
  ENSP ID: ENSP00000395728
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGVYGKKSGATHSIEEELNIHISRGTRTRTLLSSRRFCSCCRQPTNLPGSFGPGTAHLPPGPGLQPLLERDPLQPAEATPGALAAQESLPVPAGHASH

SEQ ID NO: 84480 - protein, 257 aa, Homo sapiens
  Payload ID: 16806
  Gene Symbol: SREBF2
  Gene Name: sterol regulatory element binding transcription factor 2
  ENSP ID: ENSP00000412287
  MOD_RES (1)..(1): Any amino acid
XSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKAASRALGLHPGHLSTSPTRCVQGFLVTSWEKQAFCLSLLSSCSCCSARFPAWLRVRVRDNRGCFSGVFLHEATVRLMAGASPTRTHQLLEHSLRRRTTQSTKH

SEQ ID NO: 84481 - protein, 654 aa, Homo sapiens
  Payload ID: 16806
  Gene Symbol: SREBF2
  Gene Name: sterol regulatory element binding transcription factor 2
  ENSP ID: ENSP00000484441
MLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGVYGKKSGATHSIEEELNIHISRGTRTRTLLSSRRFCSCCRQPTNLPGSFGPGTAHLPPGPGLQPLLERDPLQPAEATPGALAAQESLPVPAGHASH

SEQ ID NO: 84482 - protein, 299 aa, Homo sapiens
  Payload ID: 16807
  Gene Symbol: SC5D
  Gene Name: sterol-C5-desaturase
  Uniprot ID: O75845
  ENSP ID: ENSP00000264027
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSHSGNGCKNEKLFNGEFTKTE

SEQ ID NO: 84483 - protein, 299 aa, Homo sapiens; identical to SEQ ID NO: 84482
  Payload ID: 16807
  Gene Symbol: SC5D
  Gene Name: sterol-C5-desaturase
  Uniprot ID: O75845
  ENSP ID: ENSP00000376539

SEQ ID NO: 84484 - protein, 228 aa, Homo sapiens
  Payload ID: 16807
  Gene Symbol: SC5D
  Gene Name: sterol-C5-desaturase
  ENSP ID: ENSP00000432550
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGNGCKNEKLFNGEFTKTE

SEQ ID NO: 84485 - protein, 177 aa, Homo sapiens
  Payload ID: 16807
  Gene Symbol: SC5D
  Gene Name: sterol-C5-desaturase
  ENSP ID: ENSP00000436290
MDLVLRVADYYFFTPYVYPATWPEDDIFRQAISLLIVTNVGAYILYFFCATLSYYFVFDHALMKHPQFLKYWKFHFQNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHP

SEQ ID NO: 84486 - protein, 63 aa, Homo sapiens
  Payload ID: 16808
  Gene Symbol: STRA13
  Gene Name: stimulated by retinoic acid 13
  Uniprot ID: A8MT69
  ENSP ID: ENSP00000302951
MEGAGAGSGFRKELVSRLLHLHFKDDKTKEAAVRGVRQAQAEDALRVDVDQLEKVLPQLLLDF

SEQ ID NO: 84487 - protein, 81 aa, Homo sapiens
  Payload ID: 16808
  Gene Symbol: STRA13
  Gene Name: stimulated by retinoic acid 13
  Uniprot ID: A8MT69
  ENSP ID: ENSP00000376168
MEGAGAGSGFRKELVSRLLHLHFKDDKTKVSGDALQLMVELLKVFVVEAAVRGVRQAQAEDALRVDVDQLEKVLPQLLLDF

SEQ ID NO: 84488 - protein, 58 aa, Homo sapiens
  Payload ID: 16808
  Gene Symbol: STRA13
  Gene Name: stimulated by retinoic acid 13
  Uniprot ID: A8MT69
  ENSP ID: ENSP00000462015
MEGAGAGSGFRKELVSRLLHLHFKDDKTKEAAVRGVRQAQAEDALRVDVDQLEKLLDF

SEQ ID NO: 84489 - protein, 75 aa, Homo sapiens
  Payload ID: 16808
  Gene Symbol: STRA13
  Gene Name: stimulated by retinoic acid 13
  ENSP ID: ENSP00000463974
EGAGAGSGFRKELVSRLLHLHFKDDKTKVSGDALQLMVELLKVFVVEAAVRGVRQAQAEDALRVDVDQLEKLLDF

SEQ ID NO: 84490 - protein, 66 aa, Homo sapiens
  Payload ID: 16808
  Gene Symbol: STRA13
  Gene Name: stimulated by retinoic acid 13
  ENSP ID: ENSP00000464024
  MOD_RES (1)..(1): Any amino acid
XPLPGTKPALHAGNQELVSRLLHLHFKDDKTKEAAVRGVRQAQAEDALRVDVDQLEKVLPQLLLDF

SEQ ID NO: 84491 - protein, 131 aa, Homo sapiens
  Payload ID: 16808
  Gene Symbol: STRA13
  Gene Name: stimulated by retinoic acid 13
  ENSP ID: ENSP00000464357
MEGAGAGSGFRKELVSRLLHLHFKDDKTKVSGDALQLMVELLKVFVVGEPRAHAPSGHSIRNFAFFQRENQDVFSRFPQGPKLGSPEPVCQKQQSAACGRPRQKTRSVWTWTSWRRCFRSCSWTSRDLSRG

SEQ ID NO: 84492 - protein, 667 aa, Homo sapiens
  Payload ID: 16809
  Gene Symbol: STRA6
  Gene Name: stimulated by retinoic acid 6
  Uniprot ID: Q9BX79
  ENSP ID: ENSP00000326085
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 84493 - protein, 667 aa, Homo sapiens; identical to SEQ ID NO: 84492
  Payload ID: 16809
  Gene Symbol: STRA6
  Gene Name: stimulated by retinoic acid 6
  Uniprot ID: Q9BX79
  ENSP ID: ENSP00000378537

SEQ ID NO: 84494 - protein, 659 aa, Homo sapiens
  Payload ID: 16809
  Gene Symbol: STRA6
  Gene Name: stimulated by retinoic acid 6
  ENSP ID: ENSP00000400403
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 84495 - protein, 159 aa, Homo sapiens
  Payload ID: 16809
  Gene Symbol: STRA6
  Gene Name: stimulated by retinoic acid 6
  Uniprot ID: Q9BX79
  ENSP ID: ENSP00000407176
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGNLPKITELRLVRAWI

SEQ ID NO: 84496 - protein, 667 aa, Homo sapiens; identical to SEQ ID NO: 84492
  Payload ID: 16809
  Gene Symbol: STRA6
  Gene Name: stimulated by retinoic acid 6
  Uniprot ID: Q9BX79
  ENSP ID: ENSP00000410221

SEQ ID NO: 84497 - protein, 658 aa, Homo sapiens
  Payload ID: 16809
  Gene Symbol: STRA6
  Gene Name: stimulated by retinoic acid 6
  Uniprot ID: Q9BX79
  ENSP ID: ENSP00000413012
MSSQPAGNQTSPGATEDYSYGSWYIDEPQGGEELQPEGEVPSCHTSIPPGLYHACLASLSILVLLLLAMLVRRRQLWPDCVRGRPGLPRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 84498 - protein, 704 aa, Homo sapiens
  Payload ID: 16809
  Gene Symbol: STRA6
  Gene Name: stimulated by retinoic acid 6
  Uniprot ID: Q9BX79
  ENSP ID: ENSP00000440238
MQIRLLRAELVVPLWQFIRQWPPGSDGWGQMEEKGQRMSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 84499 - protein, 706 aa, Homo sapiens
  Payload ID: 16809
  Gene Symbol: STRA6
  Gene Name: stimulated by retinoic acid 6
  Uniprot ID: Q9BX79
  ENSP ID: ENSP00000456609
MGGKGGGDTRGPVLFPCQLAQALSPRRAFPRELKEKGQRMSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 84500 - protein, 88 aa, Homo sapiens
  Payload ID: 16809
  Gene Symbol: STRA6
  Gene Name: stimulated by retinoic acid 6
  ENSP ID: ENSP00000458204
MSSQPAGNQTSPGATEDYSYGSWYIDEPQGGEELQPEGEVPSCHTSIPPGLYHACLASLSILVLLLLAMLVRRRQLWPDCVRGRPGLP

SEQ ID NO: 84501 - protein, 87 aa, Homo sapiens
  Payload ID: 16809
  Gene Symbol: STRA6
  Gene Name: stimulated by retinoic acid 6
  ENSP ID: ENSP00000458734
MSSQPAGNQTSPGATEDYSYGSWYIDEPQGGEELQPEGEVPSCHTSIPPGLYHACLASLSVSPTQVEPGLQAAASLGSGTCVPHWGW

SEQ ID NO: 84502 - protein, 682 aa, Homo sapiens
  Payload ID: 16809
  Gene Symbol: STRA6
  Gene Name: stimulated by retinoic acid 6
  Uniprot ID: Q9BX79
  ENSP ID: ENSP00000458827
MDSQGDWAAQEKGQRMSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 84503 - protein, 266 aa, Homo sapiens
  Payload ID: 16809
  Gene Symbol: STRA6
  Gene Name: stimulated by retinoic acid 6
  ENSP ID: ENSP00000459546
  MOD_RES (1)..(1): Any amino acid
XVRAGVTTDVSYLLAGFGIVLSEDKQEVVELVKHHLWALEVCYISALVLSCLLTFLVLMRSLVTHRAPGAADHLLPGNHGPGLPGAHACAPWQEPPALPFPGVLVNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLH

SEQ ID NO: 84504 - protein, 477 aa, Homo sapiens
  Payload ID: 16809
  Gene Symbol: STRA6
  Gene Name: stimulated by retinoic acid 6
  ENSP ID: ENSP00000461799
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSRMAAVEDWLLLPRILVIKRDNYQLGTAGRPWPGLGHLGSCWPFSWAPWEGGGLPGLSGAVHHTPSFEDYRIPSPAEAGAFSYTDRDGHLPGGPAAAGGRGTHYPEGEGRGHHGCLLPAGRLWNRALRGQAGGGGAGEAPSVGSGSVLHLSLGLVLLTHLPGPDALTGDTQDQPSSSAPRSCPGLESLASESPSLPPSHILLDELQCLPDSLYLPW

SEQ ID NO: 84505 - protein, 667 aa, Homo sapiens; identical to SEQ ID NO: 84492
  Payload ID: 16809
  Gene Symbol: STRA6
  Gene Name: stimulated by retinoic acid 6
  Uniprot ID: Q9BX79
  ENSP ID: ENSP00000479112

SEQ ID NO: 84506 - protein, 330 aa, Homo sapiens
  Payload ID: 16810
  Gene Symbol: STRA8
  Gene Name: stimulated by retinoic acid 8
  Uniprot ID: Q7Z7C7
  ENSP ID: ENSP00000275764
MGKIDVDKILFFNQEIRLWQLIMATPEENSNPHDRATPQLPAQLQELEHRVARRRLSQARHRATLAALFNNLRKTVYSQSDLIASKWQVLNKAKSHIPELEQTLDNLLKLKASFNLEDGHASSLEEVKKEYASMYSGNDSFPQNGSSPWYLNFYKQTMDLLTGSGIITPQEAALPIVSAAISHLWQNLSEERKASLRQAWAQKHRGPATLAEACREPACAEGSVKDSGVDSQGASCSLVSTPEEILFEDAFDVASFLDKSEVPSTSSSSSVLASCNPENPEEKFQLYMQIINFFKGLSCANTQVKQEASFPVDEEMIMLQCTETFDDEDL

SEQ ID NO: 84507 - protein, 98 aa, Homo sapiens
  Payload ID: 16811
  Gene Symbol: SCRG1
  Gene Name: stimulator of chondrogenesis 1
  Uniprot ID: O75711
  ENSP ID: ENSP00000296506
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 84508 - protein, 92 aa, Homo sapiens
  Payload ID: 16811
  Gene Symbol: SCRG1
  Gene Name: stimulator of chondrogenesis 1
  ENSP ID: ENSP00000425404
MKLMVLVFTIGLTLLLGVQAMPANRLSCYRKILKDHNCHNLPEGVADLTQIDVNVQDHFWDGKGCEMICYCNFSELLCCPKCHHIFILLRNL

SEQ ID NO: 84509 - protein, 303 aa, Homo sapiens
  Payload ID: 16812
  Gene Symbol: STUB1
  Gene Name: STIP1 homology and U-box containing protein 1, E3 ubiquitin protein ligase
  Uniprot ID: Q9UNE7
  ENSP ID: ENSP00000219548
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 84510 - protein, 213 aa, Homo sapiens
  Payload ID: 16812
  Gene Symbol: STUB1
  Gene Name: STIP1 homology and U-box containing protein 1, E3 ubiquitin protein ligase
  ENSP ID: ENSP00000456591
MKGKEEKEGGARLGAGGGSPEKSPSAQELKEQGNRLFVGRKYPEAAACYGRAIMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLC

SEQ ID NO: 84511 - protein, 231 aa, Homo sapiens
  Payload ID: 16812
  Gene Symbol: STUB1
  Gene Name: STIP1 homology and U-box containing protein 1, E3 ubiquitin protein ligase
  Uniprot ID: Q9UNE7
  ENSP ID: ENSP00000456875
MQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 84512 - protein, 157 aa, Homo sapiens
  Payload ID: 16812
  Gene Symbol: STUB1
  Gene Name: STIP1 homology and U-box containing protein 1, E3 ubiquitin protein ligase
  ENSP ID: ENSP00000457090
  MOD_RES (1)..(1): Any amino acid
XIPSALRIAKKKRWNSIEERRIHQESELHSYLSRLIAAERERELEECQRNHEGDEDDSHVRAQQACIEAKHVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 84513 - protein, 231 aa, Homo sapiens; identical to SEQ ID NO: 84511
  Payload ID: 16812
  Gene Symbol: STUB1
  Gene Name: STIP1 homology and U-box containing protein 1, E3 ubiquitin protein ligase
  Uniprot ID: Q9UNE7
  ENSP ID: ENSP00000457228

SEQ ID NO: 84514 - protein, 185 aa, Homo sapiens
  Payload ID: 16812
  Gene Symbol: STUB1
  Gene Name: STIP1 homology and U-box containing protein 1, E3 ubiquitin protein ligase
  ENSP ID: ENSP00000457583
  MOD_RES (1)..(1): Any amino acid
XAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQVRPAAGGAGPVAWSWAP

SEQ ID NO: 84515 - protein, 24 aa, Homo sapiens
  Payload ID: 16812
  Gene Symbol: STUB1
  Gene Name: STIP1 homology and U-box containing protein 1, E3 ubiquitin protein ligase
  ENSP ID: ENSP00000476751
  MOD_RES (1)..(1): Any amino acid
XIPNLAMKEVIDAFISENGWVEDY

SEQ ID NO: 84516 - protein, 288 aa, Homo sapiens [sequence omitted]

SEQ ID NO: 84517 - protein, 123 aa, Homo sapiens
  Payload ID: 16813
  Gene Symbol: STOM
  Gene Name: stomatin
  Uniprot ID: P27105
  ENSP ID: ENSP00000339607
MAEKRHTRDSEAQRLPDSFKDSPSKGLGPCGWILVAFSFLFTVITFPISIWMCIKVIAAEGEMNASRALKEASMVITESPAALQLRYLQTLTTIAAEKNSTIVFPLPIDMLQGIIGAKHSHLG

SEQ ID NO: 84518 - protein, 168 aa, Homo sapiens
  Payload ID: 16813
  Gene Symbol: STOM
  Gene Name: stomatin
  ENSP ID: ENSP00000445764
MAEKRHTRDSEAQRLPDSFKDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQISSLRL

SEQ ID NO: 84519 - protein, 355 aa, Homo sapiens
  Payload ID: 16814
  Gene Symbol: STOML1
  Gene Name: stomatin (EPB72)-like 1
  Uniprot ID: Q9UBI4
  ENSP ID: ENSP00000319323
MPDVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPDTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 84520 - protein, 348 aa, Homo sapiens
  Payload ID: 16814
  Gene Symbol: STOML1
  Gene Name: stomatin (EPB72)-like 1
  Uniprot ID: Q9UBI4
  ENSP ID: ENSP00000319384
MLGRSGYRALPLGDFDRFQQSSFGFLGSQKGCLSPERGGVGTGADVPQSWPSCLCHGLISFLGFLLLLVTFPISGWFALKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 84521 - protein, 327 aa, Homo sapiens
  Payload ID: 16814
  Gene Symbol: STOML1
  Gene Name: stomatin (EPB72)-like 1
  Uniprot ID: Q9UBI4
  ENSP ID: ENSP00000352788
MLGRSGYRALPLGDFDRFQQSSFGFLGSQKGCLSPERGGVGTGADVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPGRGRVGHGVPDGIPDVVVEMAEADLRALLCRELRPLGAYMSGRLKVKGDLAMAMKLEAVLRALK

SEQ ID NO: 84522 - protein, 398 aa, Homo sapiens
  Payload ID: 16814
  Gene Symbol: STOML1
  Gene Name: stomatin (EPB72)-like 1
  Uniprot ID: Q9UBI4
  ENSP ID: ENSP00000442478
MLGRSGYRALPLGDFDRFQQSSFGFLGSQKGCLSPERGGVGTGADVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 84523 - protein, 91 aa, Homo sapiens
  Payload ID: 16814
  Gene Symbol: STOML1
  Gene Name: stomatin (EPB72)-like 1
  ENSP ID: ENSP00000455246
MPDVPQSWPSCLCHGLISFLGFLLLLVTFPISGWFALKIVPTYERMIVFRLGRIRTPQGPGMVLLLPFIDSFQRVDLRTRAFNVPPCKLAS

SEQ ID NO: 84524 - protein, 137 aa, Homo sapiens
  Payload ID: 16814
  Gene Symbol: STOML1
  Gene Name: stomatin (EPB72)-like 1
  ENSP ID: ENSP00000455690
MTDVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALL

SEQ ID NO: 84525 - protein, 347 aa, Homo sapiens
  Payload ID: 16814
  Gene Symbol: STOML1
  Gene Name: stomatin (EPB72)-like 1
  Uniprot ID: Q9UBI4
  ENSP ID: ENSP00000456343
MLGRSGYRALPLGDFDRFQQSSFGFLGSQKGCLSPERGGVGTGADVPQSWPSCLCHGLISFLGFLLLLVTFPISGWFALKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPDTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 84526 - protein, 310 aa, Homo sapiens
  Payload ID: 16814
  Gene Symbol: STOML1
  Gene Name: stomatin (EPB72)-like 1
  ENSP ID: ENSP00000456853
MIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPDTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 84527 - protein, 92 aa, Homo sapiens
  Payload ID: 16814
  Gene Symbol: STOML1
  Gene Name: stomatin (EPB72)-like 1
  ENSP ID: ENSP00000458091
MIVFRLGRIRTPQGPGMVLLLPFIDSFQRVDLRTRAFNVPPCKLASKDGAVLSVGADVQFRIWDPVLSVMTVKDLNTATRMTAQNAMTKALL

SEQ ID NO: 84528 - protein, 356 aa, Homo sapiens
  Payload ID: 16815
  Gene Symbol: STOML2
  Gene Name: stomatin (EPB72)-like 2
  Uniprot ID: Q9UJZ1
  ENSP ID: ENSP00000348886
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 84529 - protein, 311 aa, Homo sapiens
  Payload ID: 16815
  Gene Symbol: STOML2
  Gene Name: stomatin (EPB72)-like 2
  Uniprot ID: Q9UJZ1
  ENSP ID: ENSP00000395743
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 84530 - protein, 101 aa, Homo sapiens
  Payload ID: 16815
  Gene Symbol: STOML2
  Gene Name: stomatin (EPB72)-like 2
  ENSP ID: ENSP00000434531
MQMQVEAERRKRATVLESEGTRESAINVAEGKKQAQILASEAEKAEQINQAAGEASAVLAKAKAKAEAIRILAAALTQHVRGPWVGMGTGIDSGRGSLIYA

SEQ ID NO: 84531 - protein, 310 aa, Homo sapiens
  Payload ID: 16815
  Gene Symbol: STOML2
  Gene Name: stomatin (EPB72)-like 2
  ENSP ID: ENSP00000481672
MLARAARGTGALLLRGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 84532 - protein, 291 aa, Homo sapiens
  Payload ID: 16816
  Gene Symbol: STOML3
  Gene Name: stomatin (EPB72)-like 3
  Uniprot ID: Q8TAV4
  ENSP ID: ENSP00000368952
MDSRVSSPEKQDKENFVGVNNKRLGVCGWILFSLSFLLVIITFPISIWMCLKIIKEYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVLAAEGEMNASKSLKSASMVLAESPIALQLRYLQTLSTVATEKNSTIVFPLPMNILEGIGGVSYDNHKKLPNKA

SEQ ID NO: 84533 - protein, 282 aa, Homo sapiens
  Payload ID: 16816
  Gene Symbol: STOML3
  Gene Name: stomatin (EPB72)-like 3
  Uniprot ID: Q8TAV4
  ENSP ID: ENSP00000401989
MNSRGELVGVNNKRLGVCGWILFSLSFLLVIITFPISIWMCLKIIKEYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVLAAEGEMNASKSLKSASMVLAESPIALQLRYLQTLSTVATEKNSTIVFPLPMNILEGIGGVSYDNHKKLPNKA

SEQ ID NO: 84534 - protein, 1135 aa, Homo sapiens
  Payload ID: 16817
  Gene Symbol: STON1-GTF2A1L
  Gene Name: STON1-GTF2A1L readthrough
  ENSP ID: ENSP00000378234
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 84535 - protein, 1182 aa, Homo sapiens
  Payload ID: 16817
  Gene Symbol: STON1-GTF2A1L
  Gene Name: STON1-GTF2A1L readthrough
  ENSP ID: ENSP00000378236
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 84536 - protein, 1182 aa, Homo sapiens; identical to SEQ ID NO: 84535
  Payload ID: 16817
  Gene Symbol: STON1-GTF2A1L
  Gene Name: STON1-GTF2A1L readthrough
  ENSP ID: ENSP00000385499

SEQ ID NO: 84537 - protein, 1158 aa, Homo sapiens
  Payload ID: 16817
  Gene Symbol: STON1-GTF2A1L
  Gene Name: STON1-GTF2A1L readthrough
  ENSP ID: ENSP00000385701
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKQGDTRVRHGQQ

SEQ ID NO: 84538 - protein, 735 aa, Homo sapiens
  Payload ID: 16818
  Gene Symbol: STON1
  Gene Name: stonin 1
  Uniprot ID: Q9Y6Q2
  ENSP ID: ENSP00000384615
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQVEIEKKWIKIDGEDPDKIGDCITQ

SEQ ID NO: 84539 - protein, 735 aa, Homo sapiens; identical to SEQ ID NO: 84538
  Payload ID: 16818
  Gene Symbol: STON1
  Gene Name: stonin 1
  Uniprot ID: Q9Y6Q2
  ENSP ID: ENSP00000385273

SEQ ID NO: 84540 - protein, 93 aa, Homo sapiens
  Payload ID: 16818
  Gene Symbol: STON1
  Gene Name: stonin 1
  ENSP ID: ENSP00000399868
RSSYAGSLRSCDNIRIHFPVPSQWIKALWTMNLQRQKSLKAKMNRRACLGSLQELESEPVIQVTVGSAKYESAYQAVVWKIDRLPDKNSIFRA

SEQ ID NO: 84541 - protein, 905 aa, Homo sapiens
  Payload ID: 16819
  Gene Symbol: STON2
  Gene Name: stonin 2
  Uniprot ID: Q8WXE9
  ENSP ID: ENSP00000267540
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQVALGSIWLMLPTPFVHPTTLPLLFLLAMLTMFAW

SEQ ID NO: 84542 - protein, 106 aa, Homo sapiens
  Payload ID: 16819
  Gene Symbol: STON2
  Gene Name: stonin 2
  ENSP ID: ENSP00000450577
  MOD_RES (1)..(1): Any amino acid
XRINRLPDKNSASGHPHCFFCHLELGSDREVPSRFANHVNVEFSMPTTSASKASVRSISVEDKTDVRKWVNYSAHYSYQVEIEQKKSLKPDFEGDEMENPKECGVQ

SEQ ID NO: 84543 - protein, 920 aa, Homo sapiens
  Payload ID: 16819
  Gene Symbol: STON2
  Gene Name: stonin 2
  Uniprot ID: Q8WXE9
  ENSP ID: ENSP00000450857
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQTTETDNLPNPLYCSCLPHTDLKRGSKRVVKIRWNASLEVPLASSIRTMV

SEQ ID NO: 84544 - protein, 49 aa, Homo sapiens
  Payload ID: 16819
  Gene Symbol: STON2
  Gene Name: stonin 2
  ENSP ID: ENSP00000450990
MTTLDHVIATHQSEWVSFNEEPPFPAHSQGGTEEHLPGLSSSPDQSESS

SEQ ID NO: 84545 - protein, 3 aa, Homo sapiens
  Payload ID: 16819
  Gene Symbol: STON2
  Gene Name: stonin 2
  ENSP ID: ENSP00000451383
MTT

SEQ ID NO: 84546 - protein, 920 aa, Homo sapiens; identical to SEQ ID NO: 84543
  Payload ID: 16819
  Gene Symbol: STON2
  Gene Name: stonin 2
  Uniprot ID: Q8WXE9
  ENSP ID: ENSP00000477736

SEQ ID NO: 84547 - protein, 339 aa, Homo sapiens
  Payload ID: 16820
  Gene Symbol: SARAF
  Gene Name: store-operated calcium entry-associated regulatory factor
  Uniprot ID: Q96BY9
  ENSP ID: ENSP00000256255
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 84548 - protein, 218 aa, Homo sapiens
  Payload ID: 16820
  Gene Symbol: SARAF
  Gene Name: store-operated calcium entry-associated regulatory factor
  ENSP ID: ENSP00000427769
  MOD_RES (1)..(1): Any amino acid
XLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGKSKKYKFLLPRSKVQK

SEQ ID NO: 84549 - protein, 36 aa, Homo sapiens
  Payload ID: 16820
  Gene Symbol: SARAF
  Gene Name: store-operated calcium entry-associated regulatory factor
  ENSP ID: ENSP00000428245
MAAACGPGAAGYCLLLGLHLFLLTAGPALGWIPSHS

SEQ ID NO: 84550 - protein, 213 aa, Homo sapiens
  Payload ID: 16820
  Gene Symbol: SARAF
  Gene Name: store-operated calcium entry-associated regulatory factor
  ENSP ID: ENSP00000428323
IAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAYSPLHGGSGSYSVCSNSDTKTRTASGYGGTRRR

SEQ ID NO: 84551 - protein, 147 aa, Homo sapiens
  Payload ID: 16820
  Gene Symbol: SARAF
  Gene Name: store-operated calcium entry-associated regulatory factor
  ENSP ID: ENSP00000428832
MAAACGPGAAGYCLLLGLHLFLLTAGPALGWNDPALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFA

SEQ ID NO: 84552 - protein, 37 aa, Homo sapiens
  Payload ID: 16820
  Gene Symbol: SARAF
  Gene Name: store-operated calcium entry-associated regulatory factor
  ENSP ID: ENSP00000428963
MAAACGPGAAGYCLLLGLHLFLLTAGPALGWNDPVGM

SEQ ID NO: 84553 - protein, 347 aa, Homo sapiens
  Payload ID: 16820
  Gene Symbol: SARAF
  Gene Name: store-operated calcium entry-associated regulatory factor
  ENSP ID: ENSP00000429538
  MOD_RES (1)..(1): Any amino acid
XAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSDMVVPGDDKVESWSQTLDAEILDFSSLSL

SEQ ID NO: 84554 - protein, 202 aa, Homo sapiens
  Payload ID: 16820
  Gene Symbol: SARAF
  Gene Name: store-operated calcium entry-associated regulatory factor
  ENSP ID: ENSP00000429630
MLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNT

SEQ ID NO: 84555 - protein, 37 aa, Homo sapiens; identical to SEQ ID NO: 84552
  Payload ID: 16820
  Gene Symbol: SARAF
  Gene Name: store-operated calcium entry-associated regulatory factor
  ENSP ID: ENSP00000430477

SEQ ID NO: 84556 - protein, 40 aa, Homo sapiens
  Payload ID: 16820
  Gene Symbol: SARAF
  Gene Name: store-operated calcium entry-associated regulatory factor
  ENSP ID: ENSP00000431005
MAAACGPGAAGYCLLLGLHLFLLTAGPALGWNDPECCCGM

SEQ ID NO: 84557 - protein, 167 aa, Homo sapiens
  Payload ID: 16820
  Gene Symbol: SARAF
  Gene Name: store-operated calcium entry-associated regulatory factor
  Uniprot ID: Q96BY9
  ENSP ID: ENSP00000441351
MSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 84558 - protein, 989 aa, Homo sapiens
  Payload ID: 16821
  Gene Symbol: STOX1
  Gene Name: storkhead box 1
  Uniprot ID: Q6ZVD7
  ENSP ID: ENSP00000298596
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLVSMESCAESAQENAAPISHCQSCQCFRDMHTQDVQEAPVAAEVTRKSHRGLGESVSWVQNGAVSVSAEHHICESTKPLPYTRDKEKGKKFGFSLLWRSLSRKEKPKTEHSSFSAQFPPEEWPVRDEDDLDNIPRDVEHEIIKRINPILTVDNLIKHTVLMQKYEEQKKYNSQGTSTDMLTIGHKYPSKEGVKKRQGLSAKPQGQGHSRRDRHKARNQGSEFQPGSIRLEKHPKLPATQPIPRIKSPNEMVGQKPLGEITTVLGSHLIYKKRISNPFQGLSHRGSTISKGHKIQKTSDLKPSQTGPKEKPFQKPRSLDSSRIFDGKAKEPYAEQPNDKMEAESIYINDPTVKPINDDFRGHLFSHPQQSMLQNDGKCCPFMESMLRYEVYGGENEVIPEVLRKSHSHFDKLGETKQTPHSLPSRGASFSDRTPSACRLVDNTIHQFQNLGLLDYPVGVNPLRQAARQDKDSEELLRKGFVQDAETTSLENEQLSNDDQALYQNEVEDDDGACSSLYLEEDDISENDDLRQMLPGHSQYSFTGGSQGNHLGKQKVIERSLTEYNSTMERVESQVLKRNECYKPTGLHATPGESQEPNLSAESCGLNSGAQFGFNYEEEPSVAKCVQASAPADERIFDYYSARKASFEAEVIQDTIGDTGKKPASWSQSPQNQEMRKHFPQKFQLFNTSHMPVLAQDVQYEHSHLEGTENHSMAGDSGIDSPRTQSLGSNNSVILDGLKRRQNFLQNVEGTKSSQPLTSNSLLPLTPVINV

SEQ ID NO: 84559 - protein, 169 aa, Homo sapiens
  Payload ID: 16821
  Gene Symbol: STOX1
  Gene Name: storkhead box 1
  Uniprot ID: Q6ZVD7
  ENSP ID: ENSP00000382115
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGHRVWDLIIQSFWMD

SEQ ID NO: 84560 - protein, 227 aa, Homo sapiens
  Payload ID: 16821
  Gene Symbol: STOX1
  Gene Name: storkhead box 1
  Uniprot ID: Q6ZVD7
  ENSP ID: ENSP00000382118
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLDTESGI

SEQ ID NO: 84561 - protein, 989 aa, Homo sapiens; identical to SEQ ID NO: 84558
  Payload ID: 16821
  Gene Symbol: STOX1
  Gene Name: storkhead box 1
  Uniprot ID: Q6ZVD7
  ENSP ID: ENSP00000382121

SEQ ID NO: 84562 - protein, 926 aa, Homo sapiens
  Payload ID: 16822
  Gene Symbol: STOX2
  Gene Name: storkhead box 2
  Uniprot ID: Q9P2F5
  ENSP ID: ENSP00000311257
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRTRESLASNTSSIVESNRRQNPALSPAHGGAGPAFNFRASAEPPTNEAEKLQKPSNCLQASVTSV

SEQ ID NO: 84563 - protein, 74 aa, Homo sapiens
  Payload ID: 16822
  Gene Symbol: STOX2
  Gene Name: storkhead box 2
  ENSP ID: ENSP00000422118
  MOD_RES (1)..(1): Any amino acid
XDVSPISMSPISQSQFIPLGEILCLAISAMNSARKPVTQEALMEHLTTCFPVLGRAWLPTHQALLKVTVVRTPL

SEQ ID NO: 84564 - protein, 155 aa, Homo sapiens
  Payload ID: 16822
  Gene Symbol: STOX2
  Gene Name: storkhead box 2
  ENSP ID: ENSP00000425388
MSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRK

SEQ ID NO: 84565 - protein, 219 aa, Homo sapiens
  Payload ID: 16822
  Gene Symbol: STOX2
  Gene Name: storkhead box 2
  ENSP ID: ENSP00000426209
  MOD_RES (1)..(1): Any amino acid
XSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRN

SEQ ID NO: 84566 - protein, 248 aa, Homo sapiens [sequence omitted]

SEQ ID NO: 84567 - protein, 1392 aa, Homo sapiens
  Payload ID: 16824
  Gene Symbol: SBNO1
  Gene Name: strawberry notch homolog 1 (Drosophila)
  Uniprot ID: A3KN83
  ENSP ID: ENSP00000267176
MVEPGQDLLLAALSESGISPNDLFDIDGGDAGLATPMPTPSVQQSVPLSALELGLETEAAVPVKQEPETVPTPALLNVRQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSNNSSPRDSPCKENKIKKRKGEEITREAKKARKVGGLTGSSSDDSGSESDASDNEESDYESSKNMSSGDDDDFNPFLDESNEDDENDPWLIRKDHKKNKEKKKKKSIDPDSIQSALLASGLGSKRPSFSSTPVISPAPNSTPANSNTNSNSSLITSQDAVERAQQMKKDLLDKLEKLAEDLPPNTLDELIDELGGPENVAEMTGRKGRVVSNDDGSISYESRSELDVPVEILNITEKQRFMDGDKNIAIISEAASSGISLQADRRAKNQRRRVHMTLELPWSADRAIQQFGRTHRSNQVTAPEYVFLISELAGEQRFASIVAKRLESLGALTHGDRRATESRDLSRFNFDNKYGRNALEIVMKSIVNLDSPMVSPPPDYPGEFFKDVRQGLIGVGLINVEDRSGILTLDKDYNNIGKFLNRILGMEVHQQNALFQYFADTLTAVVQNAKKNGRYDMGILDLGSGDEKVRKSDVKKFLTPGYSTSGHVELYTISVERGMSWEEATKIWAELTGPDDGFYLSLQIRNNKKTAILVKEVNPKKKLFLVYRPNTGKQLKLEIYADLKKKYKKVVSDDALMHWLDQYNSSADTCTHAYWRGNCKKASLGLVCEIGLRCRTYYVLCGSVLSVWTKVEGVLASVSGTNVKMQIVRLRTEDGQRIVGLIIPANCVSPLVNLLSTSDQSQQLAVQQKQLWQQHHPQSITNLSNA

SEQ ID NO: 84568 - protein, 1393 aa, Homo sapiens
  Payload ID: 16824
  Gene Symbol: SBNO1
  Gene Name: strawberry notch homolog 1 (Drosophila)
  Uniprot ID: A3KN83
  ENSP ID: ENSP00000387361
MVEPGQDLLLAALSESGISPNDLFDIDGGDAGLATPMPTPSVQQSVPLSALELGLETEAAVPVKQEPETVPTPALLNVRQQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSNNSSPRDSPCKENKIKKRKGEEITREAKKARKVGGLTGSSSDDSGSESDASDNEESDYESSKNMSSGDDDDFNPFLDESNEDDENDPWLIRKDHKKNKEKKKKKSIDPDSIQSALLASGLGSKRPSFSSTPVISPAPNSTPANSNTNSNSSLITSQDAVERAQQMKKDLLDKLEKLAEDLPPNTLDELIDELGGPENVAEMTGRKGRVVSNDDGSISYESRSELDVPVEILNITEKQRFMDGDKNIAIISEAASSGISLQADRRAKNQRRRVHMTLELPWSADRAIQQFGRTHRSNQVTAPEYVFLISELAGEQRFASIVAKRLESLGALTHGDRRATESRDLSRFNFDNKYGRNALEIVMKSIVNLDSPMVSPPPDYPGEFFKDVRQGLIGVGLINVEDRSGILTLDKDYNNIGKFLNRILGMEVHQQNALFQYFADTLTAVVQNAKKNGRYDMGILDLGSGDEKVRKSDVKKFLTPGYSTSGHVELYTISVERGMSWEEATKIWAELTGPDDGFYLSLQIRNNKKTAILVKEVNPKKKLFLVYRPNTGKQLKLEIYADLKKKYKKVVSDDALMHWLDQYNSSADTCTHAYWRGNCKKASLGLVCEIGLRCRTYYVLCGSVLSVWTKVEGVLASVSGTNVKMQIVRLRTEDGQRIVGLIIPANCVSPLVNLLSTSDQSQQLAVQQKQLWQQHHPQSITNLSNA

SEQ ID NO: 84569 - protein, 1393 aa, Homo sapiens; identical to SEQ ID NO: 84568
  Payload ID: 16824
  Gene Symbol: SBNO1
  Gene Name: strawberry notch homolog 1 (Drosophila)
  Uniprot ID: A3KN83
  ENSP ID: ENSP00000473665

SEQ ID NO: 84570 - protein, 1366 aa, Homo sapiens
  Payload ID: 16825
  Gene Symbol: SBNO2
  Gene Name: strawberry notch homolog 2 (Drosophila)
  Uniprot ID: Q9Y2G9
  ENSP ID: ENSP00000354733
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 84571 - protein, 1309 aa, Homo sapiens
  Payload ID: 16825
  Gene Symbol: SBNO2
  Gene Name: strawberry notch homolog 2 (Drosophila)
  Uniprot ID: Q9Y2G9
  ENSP ID: ENSP00000400762
MREPLPGSASWGTPGPPSAGTMSQLQLWLQFEALNKDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 84572 - protein, 128 aa, Homo sapiens
  Payload ID: 16825
  Gene Symbol: SBNO2
  Gene Name: strawberry notch homolog 2 (Drosophila)
  ENSP ID: ENSP00000466861
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADS

SEQ ID NO: 84573 - protein, 111 aa, Homo sapiens
  Payload ID: 16825
  Gene Symbol: SBNO2
  Gene Name: strawberry notch homolog 2 (Drosophila)
  ENSP ID: ENSP00000468302
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSV

SEQ ID NO: 84574 - protein, 1356 aa, Homo sapiens
  Payload ID: 16825
  Gene Symbol: SBNO2
  Gene Name: strawberry notch homolog 2 (Drosophila)
  ENSP ID: ENSP00000468520
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGPLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 84575 - protein, 128 aa, Homo sapiens; identical to SEQ ID NO: 84572
  Payload ID: 16825
  Gene Symbol: SBNO2
  Gene Name: strawberry notch homolog 2 (Drosophila)
  ENSP ID: ENSP00000468534

SEQ ID NO: 84576 - protein, 1366 aa, Homo sapiens; identical to SEQ ID NO: 84570
  Payload ID: 16825
  Gene Symbol: SBNO2
  Gene Name: strawberry notch homolog 2 (Drosophila)
  Uniprot ID: Q9Y2G9
  ENSP ID: ENSP00000477651

SEQ ID NO: 84577 - protein, 1309 aa, Homo sapiens; identical to SEQ ID NO: 84571
  Payload ID: 16825
  Gene Symbol: SBNO2
  Gene Name: strawberry notch homolog 2 (Drosophila)
  Uniprot ID: Q9Y2G9
  ENSP ID: ENSP00000482802

SEQ ID NO: 84578 - protein, 111 aa, Homo sapiens; identical to SEQ ID NO: 84573
  Payload ID: 16825
  Gene Symbol: SBNO2
  Gene Name: strawberry notch homolog 2 (Drosophila)
  ENSP ID: ENSP00000488056

SEQ ID NO: 84579 - protein, 128 aa, Homo sapiens; identical to SEQ ID NO: 84572
  Payload ID: 16825
  Gene Symbol: SBNO2
  Gene Name: strawberry notch homolog 2 (Drosophila)
  ENSP ID: ENSP00000488079

SEQ ID NO: 84580 - protein, 1356 aa, Homo sapiens; identical to SEQ ID NO: 84574
  Payload ID: 16825
  Gene Symbol: SBNO2
  Gene Name: strawberry notch homolog 2 (Drosophila)
  ENSP ID: ENSP00000488286

SEQ ID NO: 84581 - protein, 1366 aa, Homo sapiens; identical to SEQ ID NO: 84570
  Payload ID: 16825
  Gene Symbol: SBNO2
  Gene Name: strawberry notch homolog 2 (Drosophila)
  Uniprot ID: Q9Y2G9
  ENSP ID: ENSP00000488808

SEQ ID NO: 84582 - protein, 128 aa, Homo sapiens; identical to SEQ ID NO: 84572
  Payload ID: 16825
  Gene Symbol: SBNO2
  Gene Name: strawberry notch homolog 2 (Drosophila)
  ENSP ID: ENSP00000488832

SEQ ID NO: 84583 - protein, 66 aa, Homo sapiens
  Payload ID: 16826
  Gene Symbol: SERP1
  Gene Name: stress-associated endoplasmic reticulum protein 1
  Uniprot ID: Q9Y6X1
  ENSP ID: ENSP00000239944
MVAKQRIRMANEKHSKNITQRGNVAKTSRNAPEEKASVGPWLLALFIFVVCGSAIFQIIQSIRMGM

SEQ ID NO: 84584 - protein, 78 aa, Homo sapiens
  Payload ID: 16826
  Gene Symbol: SERP1
  Gene Name: stress-associated endoplasmic reticulum protein 1
  ENSP ID: ENSP00000419472
MVAKQRIRMANEKHSKNITQRGNVAKTSRNAPEEKASVGPWLLALFIFVVCGSGKWLGGSHQVESWVERIWDDVVTGQ

SEQ ID NO: 84585 - protein, 55 aa, Homo sapiens
  Payload ID: 16826
  Gene Symbol: SERP1
  Gene Name: stress-associated endoplasmic reticulum protein 1
  ENSP ID: ENSP00000420002
MVAKQRIRMANEKHSKNITQRGNVAKTSQFSRLFKVSGWACEVTDLKMFPFSCEF

SEQ ID NO: 84586 - protein, 66 aa, Homo sapiens; identical to SEQ ID NO: 84583
  Payload ID: 16826
  Gene Symbol: SERP1
  Gene Name: stress-associated endoplasmic reticulum protein 1
  Uniprot ID: Q9Y6X1
  ENSP ID: ENSP00000420076

SEQ ID NO: 84587 - protein, 65 aa, Homo sapiens
  Payload ID: 16827
  Gene Symbol: SERP2
  Gene Name: stress-associated endoplasmic reticulum protein family member 2
  Uniprot ID: Q8N6R1
  ENSP ID: ENSP00000368477
MVAKQRIRMANEKHSKNITQRGNVAKTLRPQEEKYPVGPWLLALFVFVVCGSAIFQIIQSIRMGM

SEQ ID NO: 84588 - protein, 79 aa, Homo sapiens
  Payload ID: 16827
  Gene Symbol: SERP2
  Gene Name: stress-associated endoplasmic reticulum protein family member 2
  ENSP ID: ENSP00000433253
MVAKQRIRMANEKHSKNITQRGNVAKTLRPQEEKYPVGPWLLALFVFVVCGSVSVFSLVYGNKIIVQDPLQIGVVIQEM

SEQ ID NO: 84589 - protein, 84 aa, Homo sapiens
  Payload ID: 16827
  Gene Symbol: SERP2
  Gene Name: stress-associated endoplasmic reticulum protein family member 2
  ENSP ID: ENSP00000435473
MVAKQRIRMANEKHSKNITQRGNVAKTLRPQEEKYPVGPWLLALFVFVVCGSGQPHKLASPGDCQNFLKVVTSRGSHPTPKTGN

SEQ ID NO: 84590 - protein, 41 aa, Homo sapiens
  Payload ID: 16827
  Gene Symbol: SERP2
  Gene Name: stress-associated endoplasmic reticulum protein family member 2
  ENSP ID: ENSP00000477711
LFVFVVCGSGQPHKLASPGDCQNFLKVVTSRGSHPTPKTGN

SEQ ID NO: 84591 - protein, 543 aa, Homo sapiens
  Payload ID: 16828
  Gene Symbol: STIP1
  Gene Name: stress-induced phosphoprotein 1
  Uniprot ID: P31948
  ENSP ID: ENSP00000305958
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 84592 - protein, 590 aa, Homo sapiens
  Payload ID: 16828
  Gene Symbol: STIP1
  Gene Name: stress-induced phosphoprotein 1
  Uniprot ID: P31948
  ENSP ID: ENSP00000351646
MESGSPMGEVEISRTIRTNGRGQRGYDWQCKRPIRVAEVRSSLHSWSLRWVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 84593 - protein, 138 aa, Homo sapiens
  Payload ID: 16828
  Gene Symbol: STIP1
  Gene Name: stress-induced phosphoprotein 1
  ENSP ID: ENSP00000441036
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAVQPARQPRRCEATSHGRP

SEQ ID NO: 84594 - protein, 236 aa, Homo sapiens
  Payload ID: 16828
  Gene Symbol: STIP1
  Gene Name: stress-induced phosphoprotein 1
  ENSP ID: ENSP00000442704
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQVLFFSLLTVTYL

SEQ ID NO: 84595 - protein, 137 aa, Homo sapiens
  Payload ID: 16828
  Gene Symbol: STIP1
  Gene Name: stress-induced phosphoprotein 1
  ENSP ID: ENSP00000443416
ACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEYVESERRPCWKWRTKAGR

SEQ ID NO: 84596 - protein, 519 aa, Homo sapiens
  Payload ID: 16828
  Gene Symbol: STIP1
  Gene Name: stress-induced phosphoprotein 1
  Uniprot ID: P31948
  ENSP ID: ENSP00000445957
MEQVNELKEKGNKALSVGNIDDALQCYSEAIKLDPHNHVLYSNRSAAYAKKGDYQKAYEDGCKTVDLKPDWGKGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 84597 - protein, 837 aa, Homo sapiens
  Payload ID: 16829
  Gene Symbol: STRIP1
  Gene Name: striatin interacting protein 1
  Uniprot ID: Q5VSL9
  ENSP ID: ENSP00000358810
MEPAVGGPGPLIVNNKQPQPPPPPPPAAAQPPPGAPRAAAGLLPGGKAREFNRNQRKDSEGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 84598 - protein, 742 aa, Homo sapiens
  Payload ID: 16829
  Gene Symbol: STRIP1
  Gene Name: striatin interacting protein 1
  Uniprot ID: Q5VSL9
  ENSP ID: ENSP00000358811
MNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 84599 - protein, 212 aa, Homo sapiens
  Payload ID: 16829
  Gene Symbol: STRIP1
  Gene Name: striatin interacting protein 1
  Uniprot ID: Q5VSL9
  ENSP ID: ENSP00000476025
MEPAVGGPGPLIVNNKQPQPPPPPPPAAAQPPPGAPRAAAGLLPGGKAREFNRNQRKDSEGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIEHCCVRPAVSALAGGQAQD

SEQ ID NO: 84600 - protein, 834 aa, Homo sapiens
  Payload ID: 16830
  Gene Symbol: STRIP2
  Gene Name: striatin interacting protein 2
  Uniprot ID: Q9ULQ0
  ENSP ID: ENSP00000249344
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNDIDARPWDFQAEECTLRANIEAFNSRRYDRPQDSEFSPVDNCLQSVLGQRLDLPEDFHYSYELWLEREVFSQPICWEELLQNH

SEQ ID NO: 84601 - protein, 758 aa, Homo sapiens
  Payload ID: 16830
  Gene Symbol: STRIP2
  Gene Name: striatin interacting protein 2
  Uniprot ID: Q9ULQ0
  ENSP ID: ENSP00000392393
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNGESSQSS

SEQ ID NO: 84602 - protein, 780 aa, Homo sapiens
  Payload ID: 16831
  Gene Symbol: STRN
  Gene Name: striatin, calmodulin binding protein
  Uniprot ID: O43815
  ENSP ID: ENSP00000263918
MDEQAGPGVFFSNNHPGAGGAKGLGPLAEAAAAGDGAAAAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWEKEDQCLMPEAWNVDQGVITKLKEQYKKERKGKKGVKRPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 84603 - protein, 731 aa, Homo sapiens
  Payload ID: 16831
  Gene Symbol: STRN
  Gene Name: striatin, calmodulin binding protein
  Uniprot ID: O43815
  ENSP ID: ENSP00000368513
MDEQAGPGVFFSNNHPGAGGAKGLGPLAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWGPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 84604 - protein, 713 aa, Homo sapiens
  Payload ID: 16832
  Gene Symbol: STRN3
  Gene Name: striatin, calmodulin binding protein 3
  Uniprot ID: Q13033
  ENSP ID: ENSP00000347909
MDELAGGGGGGPGMAAPPRQQQGPGGNLGLSPGGNGAAGGGGPPASEGAGPAAGPELSRPQQYTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 84605 - protein, 797 aa, Homo sapiens
  Payload ID: 16832
  Gene Symbol: STRN3
  Gene Name: striatin, calmodulin binding protein 3
  Uniprot ID: Q13033
  ENSP ID: ENSP00000350071
MDELAGGGGGGPGMAAPPRQQQGPGGNLGLSPGGNGAAGGGGPPASEGAGPAAGPELSRPQQYTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWDKDDLSPTAEVWDVDQGLISKLKEQYKKERKGKKGVKRANRTKLYDMIADLGDDELPHIPSGIINQSRSASTRMTDHEGARAEEAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 84606 - protein, 332 aa, Homo sapiens
  Payload ID: 16832
  Gene Symbol: STRN3
  Gene Name: striatin, calmodulin binding protein 3
  ENSP ID: ENSP00000451028
MDELAGGGGGGPGMAAPPRQQQGPGGNLGLSPGGNGAAGGGGPPASEGAGPAAGPELSRPQQYTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWVAC

SEQ ID NO: 84607 - protein, 112 aa, Homo sapiens
  Payload ID: 16832
  Gene Symbol: STRN3
  Gene Name: striatin, calmodulin binding protein 3
  ENSP ID: ENSP00000451233
MLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPK

SEQ ID NO: 84608 - protein, 172 aa, Homo sapiens
  Payload ID: 16832
  Gene Symbol: STRN3
  Gene Name: striatin, calmodulin binding protein 3
  ENSP ID: ENSP00000452092
  MOD_RES (1)..(1): Any amino acid
XSGDVLETFNFLENADDSDEDEENDMIEGIPEGKDKHRMNKHKIGNEGLAADLTDDPDTEEALKEFDFLVTAEDGEGAGEARSSGDGTEWDKDDLSPTAEVWDVDQGLISKLKEQYKKERKGKKGVKTEPITFPSGGGKSFIMGSDDVLLSVLGLGDLADLTVTNDADYSYD

SEQ ID NO: 84609 - protein, 139 aa, Homo sapiens
  Payload ID: 16832
  Gene Symbol: STRN3
  Gene Name: striatin, calmodulin binding protein 3
  ENSP ID: ENSP00000452542
IGNEGLAADLTDDPDTEEALKEFDFLVTAEDGEGAGEARSSGDGTEWGANRTKLYDMIADLGDDELPHIPSGIINQSRSASTRMTDHEGARAEEAEPITFPSGGGKSFIMGSDDVLLSVLGLGDLADLTVTNDADYSYD

SEQ ID NO: 84610 - protein, 753 aa, Homo sapiens
  Payload ID: 16833
  Gene Symbol: STRN4
  Gene Name: striatin, calmodulin binding protein 4
  Uniprot ID: Q9NRL3
  ENSP ID: ENSP00000263280
MMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 84611 - protein, 760 aa, Homo sapiens
  Payload ID: 16833
  Gene Symbol: STRN4
  Gene Name: striatin, calmodulin binding protein 4
  Uniprot ID: Q9NRL3
  ENSP ID: ENSP00000375777
MMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEGSFGFSSDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 84612 - protein, 634 aa, Homo sapiens
  Payload ID: 16833
  Gene Symbol: STRN4
  Gene Name: striatin, calmodulin binding protein 4
  ENSP ID: ENSP00000440901
MLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 84613 - protein, 73 aa, Homo sapiens
  Payload ID: 16833
  Gene Symbol: STRN4
  Gene Name: striatin, calmodulin binding protein 4
  ENSP ID: ENSP00000469279
MLEYALKQERAKYHKLKFGTDLNQGEKKADVSEQVSNGPVESVTLENSPLVWKEGRQLLRQYLEEVGYTDTIL

SEQ ID NO: 84614 - protein, 114 aa, Homo sapiens
  Payload ID: 16833
  Gene Symbol: STRN4
  Gene Name: striatin, calmodulin binding protein 4
  ENSP ID: ENSP00000470040
MLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGE

SEQ ID NO: 84615 - protein, 317 aa, Homo sapiens
  Payload ID: 16833
  Gene Symbol: STRN4
  Gene Name: striatin, calmodulin binding protein 4
  ENSP ID: ENSP00000470634
  MOD_RES (1)..(1): Any amino acid
XDGLPPKVTGPPPGTPQPRPHEAVILHLVLSPSLSLALYLFLCLSLSFSLSLALSAPPSPPPTRFLWLLLRRLHHGHYRGRGGEPGGLGRSHRHQRQRPQLRYAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSG

SEQ ID NO: 84616 - protein, 139 aa, Homo sapiens
  Payload ID: 16833
  Gene Symbol: STRN4
  Gene Name: striatin, calmodulin binding protein 4
  ENSP ID: ENSP00000471354
MLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLG

SEQ ID NO: 84617 - protein, 180 aa, Homo sapiens
  Payload ID: 16833
  Gene Symbol: STRN4
  Gene Name: striatin, calmodulin binding protein 4
  ENSP ID: ENSP00000471499
  MOD_RES (1)..(1): Any amino acid
XVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRHPVPAGFSF

SEQ ID NO: 84618 - protein, 103 aa, Homo sapiens
  Payload ID: 16833
  Gene Symbol: STRN4
  Gene Name: striatin, calmodulin binding protein 4
  ENSP ID: ENSP00000472429
MLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRA

SEQ ID NO: 84619 - protein, 198 aa, Homo sapiens
  Payload ID: 16833
  Gene Symbol: STRN4
  Gene Name: striatin, calmodulin binding protein 4
  ENSP ID: ENSP00000472938
  MOD_RES (1)..(1): Any amino acid
XQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 84620 - protein, 316 aa, Homo sapiens
  Payload ID: 16833
  Gene Symbol: STRN4
  Gene Name: striatin, calmodulin binding protein 4
  ENSP ID: ENSP00000473446
  MOD_RES (1)..(1): Any amino acid
XEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEAVILHLVLSPSLSLALYLFLCLSLSFSLSLALSAPPSPPPTRFLWLLLRRLHHGHYRGRGGEPGGLGRSHRHQRQRPQLRSV

SEQ ID NO: 84621 - protein, 257 aa, Homo sapiens
  Payload ID: 16833
  Gene Symbol: STRN4
  Gene Name: striatin, calmodulin binding protein 4
  Uniprot ID: Q9NRL3
  ENSP ID: ENSP00000473607
MLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELGPELHSPTEWQGALSVGKASPMPDWVGTAG

SEQ ID NO: 84622 - protein, 1221 aa, Homo sapiens
  Payload ID: 16834
  Gene Symbol: STAG1
  Gene Name: stromal antigen 1
  Uniprot ID: Q8WVM7
  ENSP ID: ENSP00000236698
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNRGLMEEDAEPIFEDVMMSSRSQLEDMNEEFEDTMVIDLPPSRNRRERAELRPDFFDSAAIIEDDSGFGMPMF

SEQ ID NO: 84623 - protein, 1258 aa, Homo sapiens
  Payload ID: 16834
  Gene Symbol: STAG1
  Gene Name: stromal antigen 1
  Uniprot ID: Q8WVM7
  ENSP ID: ENSP00000372689
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 84624 - protein, 998 aa, Homo sapiens
  Payload ID: 16834
  Gene Symbol: STAG1
  Gene Name: stromal antigen 1
  ENSP ID: ENSP00000404396
MKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 84625 - protein, 161 aa, Homo sapiens
  Payload ID: 16834
  Gene Symbol: STAG1
  Gene Name: stromal antigen 1
  ENSP ID: ENSP00000418472
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSLHVVCIHLVGRGERKRSSVYFLEAFGPSIYIPLMGTYHILSPWWMTGLNHINKTGTSHFWI

SEQ ID NO: 84626 - protein, 101 aa, Homo sapiens
  Payload ID: 16834
  Gene Symbol: STAG1
  Gene Name: stromal antigen 1
  ENSP ID: ENSP00000419093
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQRC

SEQ ID NO: 84627 - protein, 190 aa, Homo sapiens
  Payload ID: 16834
  Gene Symbol: STAG1
  Gene Name: stromal antigen 1
  ENSP ID: ENSP00000419317
  MOD_RES (1)..(1): Any amino acid
XQSLYTNRELFPKLELFTNRFKDRIVSMTLDKEYDVAVEAIRLVTLILQLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLL

SEQ ID NO: 84628 - protein, 232 aa, Homo sapiens
  Payload ID: 16834
  Gene Symbol: STAG1
  Gene Name: stromal antigen 1
  ENSP ID: ENSP00000420789
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAGQVLGTR

SEQ ID NO: 84629 - protein, 161 aa, Homo sapiens; identical to SEQ ID NO: 84625
  Payload ID: 16834
  Gene Symbol: STAG1
  Gene Name: stromal antigen 1
  ENSP ID: ENSP00000486745

SEQ ID NO: 84630 - protein, 1268 aa, Homo sapiens
  Payload ID: 16835
  Gene Symbol: STAG2
  Gene Name: stromal antigen 2
  Uniprot ID: Q8N3U4
  ENSP ID: ENSP00000218089
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNTQVTWMLAQRQQEEARQQQERAAMSYVKLRTNLQHAIRRGTSLMEDDEEPIVEDVMMSSEGRIEDLNEGMDFDTMDIDLPPSKNRRERTELKPDFFDPASIMDESVLGVSMF

SEQ ID NO: 84631 - protein, 1231 aa, Homo sapiens
  Payload ID: 16835
  Gene Symbol: STAG2
  Gene Name: stromal antigen 2
  Uniprot ID: Q8N3U4
  ENSP ID: ENSP00000360186
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 84632 - protein, 1268 aa, Homo sapiens; identical to SEQ ID NO: 84630
  Payload ID: 16835
  Gene Symbol: STAG2
  Gene Name: stromal antigen 2
  Uniprot ID: Q8N3U4
  ENSP ID: ENSP00000360187

SEQ ID NO: 84633 - protein, 1231 aa, Homo sapiens; identical to SEQ ID NO: 84631
  Payload ID: 16835
  Gene Symbol: STAG2
  Gene Name: stromal antigen 2
  Uniprot ID: Q8N3U4
  ENSP ID: ENSP00000360199

SEQ ID NO: 84634 - protein, 1231 aa, Homo sapiens; identical to SEQ ID NO: 84631
  Payload ID: 16835
  Gene Symbol: STAG2
  Gene Name: stromal antigen 2
  Uniprot ID: Q8N3U4
  ENSP ID: ENSP00000360202

SEQ ID NO: 84635 - protein, 70 aa, Homo sapiens
  Payload ID: 16835
  Gene Symbol: STAG2
  Gene Name: stromal antigen 2
  ENSP ID: ENSP00000377987
MIAAPEIPTDFNLLQESETHFSSDTDFEDIEGKNQKQGKGKTCKKGKKGPAEKGKGGNGGGKPPSGPNRM

SEQ ID NO: 84636 - protein, 115 aa, Homo sapiens
  Payload ID: 16835
  Gene Symbol: STAG2
  Gene Name: stromal antigen 2
  ENSP ID: ENSP00000377988
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALL

SEQ ID NO: 84637 - protein, 207 aa, Homo sapiens
  Payload ID: 16835
  Gene Symbol: STAG2
  Gene Name: stromal antigen 2
  ENSP ID: ENSP00000392118
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGL

SEQ ID NO: 84638 - protein, 548 aa, Homo sapiens
  Payload ID: 16835
  Gene Symbol: STAG2
  Gene Name: stromal antigen 2
  ENSP ID: ENSP00000397265
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVL

SEQ ID NO: 84639 - protein, 58 aa, Homo sapiens
  Payload ID: 16835
  Gene Symbol: STAG2
  Gene Name: stromal antigen 2
  ENSP ID: ENSP00000401309
MIAAPEIPTDFNLLQESETHFSSDTDFEDIEGKNQKQGKGKHLFFKMNFGFILSHDIL

SEQ ID NO: 84640 - protein, 40 aa, Homo sapiens
  Payload ID: 16835
  Gene Symbol: STAG2
  Gene Name: stromal antigen 2
  ENSP ID: ENSP00000405555
MIAAPEIPTDFNLLQESETHFSSDTDFEDIEGKNQKQGKG

SEQ ID NO: 84641 - protein, 154 aa, Homo sapiens
  Payload ID: 16835
  Gene Symbol: STAG2
  Gene Name: stromal antigen 2
  ENSP ID: ENSP00000405874
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDE

SEQ ID NO: 84642 - protein, 169 aa, Homo sapiens
  Payload ID: 16835
  Gene Symbol: STAG2
  Gene Name: stromal antigen 2
  ENSP ID: ENSP00000415103
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWK

SEQ ID NO: 84643 - protein, 1225 aa, Homo sapiens
  Payload ID: 16836
  Gene Symbol: STAG3
  Gene Name: stromal antigen 3
  Uniprot ID: Q9UJ98
  ENSP ID: ENSP00000319318
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 84644 - protein, 1167 aa, Homo sapiens
  Payload ID: 16836
  Gene Symbol: STAG3
  Gene Name: stromal antigen 3
  Uniprot ID: Q9UJ98
  ENSP ID: ENSP00000377586
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 84645 - protein, 172 aa, Homo sapiens
  Payload ID: 16836
  Gene Symbol: STAG3
  Gene Name: stromal antigen 3
  ENSP ID: ENSP00000393790
PSSKRRRVEGPAKPNREDVSSSQEESLQLNSIPPTPTLTSTAVKSRQPLWGLKEMEEEDGSELDFAQGSQPVAGTERSRFLGPQYFQTPHNPSGPGLGNQLMRLSLMEEDEEEELEIQDESNEERQDTDMQASSYSSTSERGLDLLDSTELDIEITESLPLLGKSPHPYNSR

SEQ ID NO: 84646 - protein, 184 aa, Homo sapiens
  Payload ID: 16836
  Gene Symbol: STAG3
  Gene Name: stromal antigen 3
  ENSP ID: ENSP00000395039
GHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGSQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 84647 - protein, 188 aa, Homo sapiens
  Payload ID: 16836
  Gene Symbol: STAG3
  Gene Name: stromal antigen 3
  ENSP ID: ENSP00000397067
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQDSGDYPLIAPGPSWKKFQGSFCEFVRTLVCQCQYSLLYDGFPMDDLISLLTGLSDSQVRAFRHTSTLAAMKLMTSL

SEQ ID NO: 84648 - protein, 1225 aa, Homo sapiens; identical to SEQ ID NO: 84643
  Payload ID: 16836
  Gene Symbol: STAG3
  Gene Name: stromal antigen 3
  Uniprot ID: Q9UJ98
  ENSP ID: ENSP00000400359

SEQ ID NO: 84649 - protein, 112 aa, Homo sapiens
  Payload ID: 16836
  Gene Symbol: STAG3
  Gene Name: stromal antigen 3
  ENSP ID: ENSP00000407884
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQ

SEQ ID NO: 84650 - protein, 144 aa, Homo sapiens
  Payload ID: 16836
  Gene Symbol: STAG3
  Gene Name: stromal antigen 3
  ENSP ID: ENSP00000409283
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCK

SEQ ID NO: 84651 - protein, 1226 aa, Homo sapiens
  Payload ID: 16836
  Gene Symbol: STAG3
  Gene Name: stromal antigen 3
  ENSP ID: ENSP00000477973
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGSQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 84652 - protein, 1167 aa, Homo sapiens; identical to SEQ ID NO: 84644
  Payload ID: 16836
  Gene Symbol: STAG3
  Gene Name: stromal antigen 3
  Uniprot ID: Q9UJ98
  ENSP ID: ENSP00000484098

SEQ ID NO: 84653 - protein, 348 aa, Homo sapiens
  Payload ID: 16837
  Gene Symbol: SDF4
  Gene Name: stromal cell derived factor 4
  Uniprot ID: Q9BRK5
  ENSP ID: ENSP00000263741
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELENVPTLPLQPIGTLNSHFVRLAAELGGGKATLTCAPLARRATWTP

SEQ ID NO: 84654 - protein, 362 aa, Homo sapiens
  Payload ID: 16837
  Gene Symbol: SDF4
  Gene Name: stromal cell derived factor 4
  Uniprot ID: Q9BRK5
  ENSP ID: ENSP00000353094
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 84655 - protein, 243 aa, Homo sapiens
  Payload ID: 16837
  Gene Symbol: SDF4
  Gene Name: stromal cell derived factor 4
  ENSP ID: ENSP00000384207
  MOD_RES (1)..(1): Any amino acid
XLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEESSTSRNFLDLRAGVCRPRYPQAAPLSAQEVLENLKDRWYQADSPPADLLLTEEEFLSFLHPEHSRGMLRFMVKEIVRDLDQDGDKQLSVPEFISLPVGTVENQQGQDIDDNWVKDR

SEQ ID NO: 84656 - protein, 254 aa, Homo sapiens
  Payload ID: 16837
  Gene Symbol: SDF4
  Gene Name: stromal cell derived factor 4
  ENSP ID: ENSP00000435962
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEESCAPLSTGSPGEPEGPLVPGGQPPCRPAADGGGVPVVPPPRAQPGNAQVHGEGDRPGPGPGR

SEQ ID NO: 84657 - protein, 211 aa, Homo sapiens
  Payload ID: 16838
  Gene Symbol: SDF2
  Gene Name: stromal cell-derived factor 2
  Uniprot ID: Q99470
  ENSP ID: ENSP00000247020
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 84658 - protein, 50 aa, Homo sapiens
  Payload ID: 16838
  Gene Symbol: SDF2
  Gene Name: stromal cell-derived factor 2
  ENSP ID: ENSP00000466083
  MOD_RES (1)..(1): Any amino acid
XRNLHSHHFTSPLSGNQENNMVDLSVGKKRCMAWPSQVRTTTGKPWKASS

SEQ ID NO: 84659 - protein, 104 aa, Homo sapiens
  Payload ID: 16838
  Gene Symbol: SDF2
  Gene Name: stromal cell-derived factor 2
  ENSP ID: ENSP00000466102
SLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQLLCKVIL

SEQ ID NO: 84660 - protein, 221 aa, Homo sapiens
  Payload ID: 16839
  Gene Symbol: SDF2L1
  Gene Name: stromal cell-derived factor 2-like 1
  Uniprot ID: Q9HCN8
  ENSP ID: ENSP00000248958
MWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEGIFIKPSVEPSAGHDEL

SEQ ID NO: 84661 - protein, 685 aa, Homo sapiens
  Payload ID: 16840
  Gene Symbol: STIM1
  Gene Name: stromal interaction molecule 1
  Uniprot ID: Q13586
  ENSP ID: ENSP00000300737
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 84662 - protein, 82 aa, Homo sapiens
  Payload ID: 16840
  Gene Symbol: STIM1
  Gene Name: stromal interaction molecule 1
  ENSP ID: ENSP00000431191
MDDDANGDVDVEESDEFLREDLNYHDPTVKHSTFHGEDKLISVEDLWKAWKSSEVYNWTVDEVVQWLITYVELPQYEETFRK

SEQ ID NO: 84663 - protein, 80 aa, Homo sapiens
  Payload ID: 16840
  Gene Symbol: STIM1
  Gene Name: stromal interaction molecule 1
  ENSP ID: ENSP00000431878
MDDDANGDVDVEESDEFLREDLNYHDPTVKHSTFHGEDKLISVEDLWKAWKSSEVYNWTVDEVVQWLITYVELPQYEETF

SEQ ID NO: 84664 - protein, 110 aa, Homo sapiens
  Payload ID: 16840
  Gene Symbol: STIM1
  Gene Name: stromal interaction molecule 1
  ENSP ID: ENSP00000432210
MDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDR

SEQ ID NO: 84665 - protein, 117 aa, Homo sapiens
  Payload ID: 16840
  Gene Symbol: STIM1
  Gene Name: stromal interaction molecule 1
  ENSP ID: ENSP00000432378
MDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQ

SEQ ID NO: 84666 - protein, 67 aa, Homo sapiens
  Payload ID: 16840
  Gene Symbol: STIM1
  Gene Name: stromal interaction molecule 1
  ENSP ID: ENSP00000432383
MDDDANGDVDVEESDEFLREDLNYHDPTVKHSTFHGEDKLISVEDLWKAWKSSEVYNWTVDEVVQWL

SEQ ID NO: 84667 - protein, 405 aa, Homo sapiens
  Payload ID: 16840
  Gene Symbol: STIM1
  Gene Name: stromal interaction molecule 1
  ENSP ID: ENSP00000433266
  MOD_RES (1)..(1): Any amino acid
XEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQYAAWLMGRRFSDRSLCSTSAGSDDQSLWKYPAPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTR

SEQ ID NO: 84668 - protein, 139 aa, Homo sapiens
  Payload ID: 16840
  Gene Symbol: STIM1
  Gene Name: stromal interaction molecule 1
  ENSP ID: ENSP00000433949
MDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKD

SEQ ID NO: 84669 - protein, 54 aa, Homo sapiens
  Payload ID: 16840
  Gene Symbol: STIM1
  Gene Name: stromal interaction molecule 1
  ENSP ID: ENSP00000434200
MDDDANGDVDVEESDEFLREDLNYHDPTVKHSTFHGEDKLISVEDLWKAWKSSE

SEQ ID NO: 84670 - protein, 512 aa, Homo sapiens
  Payload ID: 16840
  Gene Symbol: STIM1
  Gene Name: stromal interaction molecule 1
  ENSP ID: ENSP00000434767
MTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 84671 - protein, 132 aa, Homo sapiens
  Payload ID: 16840
  Gene Symbol: STIM1
  Gene Name: stromal interaction molecule 1
  ENSP ID: ENSP00000434848
MDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLCE

SEQ ID NO: 84672 - protein, 540 aa, Homo sapiens
  Payload ID: 16840
  Gene Symbol: STIM1
  Gene Name: stromal interaction molecule 1
  Uniprot ID: Q13586
  ENSP ID: ENSP00000436208
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRGSSLKANRLSSKGFDPFRFGVLPPHE

SEQ ID NO: 84673 - protein, 791 aa, Homo sapiens
  Payload ID: 16840
  Gene Symbol: STIM1
  Gene Name: stromal interaction molecule 1
  ENSP ID: ENSP00000478059
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRLVEGEAGHFLTSRVSLRRMRSLSSGQSFSSEGYGTSSPSASAAASCSSSITTITTTTTTTTTFTTVHVHPVYYHHSTSYFLQMEPYPDTPPSDSTAVMPGHSESLGDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 84674 - protein, 754 aa, Homo sapiens
  Payload ID: 16841
  Gene Symbol: STIM2
  Gene Name: stromal interaction molecule 2
  ENSP ID: ENSP00000417569
LLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEVAASYLIQAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 84675 - protein, 746 aa, Homo sapiens
  Payload ID: 16841
  Gene Symbol: STIM2
  Gene Name: stromal interaction molecule 2
  Uniprot ID: Q9P246
  ENSP ID: ENSP00000419073
LLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 84676 - protein, 599 aa, Homo sapiens
  Payload ID: 16841
  Gene Symbol: STIM2
  Gene Name: stromal interaction molecule 2
  ENSP ID: ENSP00000419383
LLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQCIHLGLGACKSE

SEQ ID NO: 84677 - protein, 221 aa, Homo sapiens
  Payload ID: 16841
  Gene Symbol: STIM2
  Gene Name: stromal interaction molecule 2
  ENSP ID: ENSP00000419536
HVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQCMIIVTSKMPLLTELVLCGFWKSEGKLESCTV

SEQ ID NO: 84678 - protein, 347 aa, Homo sapiens
  Payload ID: 16841
  Gene Symbol: STIM2
  Gene Name: stromal interaction molecule 2
  ENSP ID: ENSP00000420113
EINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWNTRECAVGDSQGPHVHGLVRFDKDFGSYSEYERKHWEVSRKCQTQLQNVTP

SEQ ID NO: 84679 - protein, 214 aa, Homo sapiens
  Payload ID: 16841
  Gene Symbol: STIM2
  Gene Name: stromal interaction molecule 2
  ENSP ID: ENSP00000473283
MSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQE

SEQ ID NO: 84680 - protein, 159 aa, Homo sapiens
  Payload ID: 16841
  Gene Symbol: STIM2
  Gene Name: stromal interaction molecule 2
  ENSP ID: ENSP00000473527
MSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPH

SEQ ID NO: 84681 - protein, 87 aa, Homo sapiens
  Payload ID: 16841
  Gene Symbol: STIM2
  Gene Name: stromal interaction molecule 2
  ENSP ID: ENSP00000473581
MSLSPPCFTEEDRFSLEALQTIHKQMDDDKDGGIEVEESDEFIREDMKYKDATNKHSHLHREDKHITIEDLWKRWKTSEVHNWTLED

SEQ ID NO: 84682 - protein, 1233 aa, Homo sapiens
  Payload ID: 16842
  Gene Symbol: SMC1A
  Gene Name: structural maintenance of chromosomes 1A
  Uniprot ID: Q14683
  ENSP ID: ENSP00000323421
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 84683 - protein, 1211 aa, Homo sapiens
  Payload ID: 16842
  Gene Symbol: SMC1A
  Gene Name: structural maintenance of chromosomes 1A
  ENSP ID: ENSP00000364489
MLEVSIPTPHRYVRGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 84684 - protein, 262 aa, Homo sapiens
  Payload ID: 16842
  Gene Symbol: SMC1A
  Gene Name: structural maintenance of chromosomes 1A
  ENSP ID: ENSP00000413509
MLEVSIPTPHRYVRGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEI

SEQ ID NO: 84685 - protein, 279 aa, Homo sapiens
  Payload ID: 16842
  Gene Symbol: SMC1A
  Gene Name: structural maintenance of chromosomes 1A
  ENSP ID: ENSP00000476416
  MOD_RES (1)..(1): Any amino acid
XMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHRWQITSRSSRLATSRPSSSLSRRSSTPRPRASLESIL

SEQ ID NO: 84686 - protein, 54 aa, Homo sapiens
  Payload ID: 16842
  Gene Symbol: SMC1A
  Gene Name: structural maintenance of chromosomes 1A
  ENSP ID: ENSP00000476958
MGFLKLIEIENFKSYKGRQIIGPFQRFTAIIGPNGSGCCGIYCHEEPQREDSSI

SEQ ID NO: 84687 - protein, 1235 aa, Homo sapiens
  Payload ID: 16843
  Gene Symbol: SMC1B
  Gene Name: structural maintenance of chromosomes 1B
  Uniprot ID: Q8NDV3
  ENSP ID: ENSP00000350036
MAHLELLLVENFKSWRGRQVIGPFRRFTCIIGPNGSGKSNVMDALSFVMGEKIANLRVKNIQELIHGAHIGKPISSSASVKIIYVEESGEEKTFARIIRGGCSEFRFNDNLVSRSVYIAELEKIGIIVKAQNCLVFQGTVESISVKKPKERTQFFEEISTSGELIGEYEEKKRKLQKAEEDAQFNFNKKKNIAAERRQAKLEKEEAERYQSLLEELKMNKIQLQLFQLYHNEKKIHLLNTKLEHVNRDLSVKRESLSHHENIVKARKKEHGMLTRQLQQTEKELKSVETLLNQKRPQYIKAKENTSHHLKKLDVAKKSIKDSEKQCSKQEDDIKALETELADLDAAWRSFEKQIEEEILHKKRDIELEASQLDRYKELKEQVRKKVATMTQQLEKLQWEQKTDEERLAFEKRRHGEVQGNLKQIKEQIEDHKKRIEKLEEYTKTCMDCLKEKKQQEETLVDEIEKTKSRMSEVNEELNLIRSELQNAGIDTHEGKRQQKRAEVLEHLKRLYPDSVFGRLFDLCHPIHKKYQLAVTKVFGRFITAIVVASEKVAKDCIRFLKEERAEPETFLALDYLDIKPINERLRELKGCKMVIDVIKTQFPQLKKVIQFVCGNGLVCETMEEARHIALSGPERQKTVALDGTLFLKSGVISGGSSDLKYKARCWDEKELKNLRDRRSQKIQELKGLMKTLRKETDLKQIQTLIQGTQTRLKYSQNELEMIKKKHLVAFYQEQSQLQSELLNIESQCIMLSEGIKERQRRIKEFQEKIDKVEDDIFQHFCEEIGVENIREFENKHVKRQQEIDQKRLEFEKQKTRLNVQLEYSRSHLKKKLNKINTLKETIQKGSEDIDHLKKAEENCLQTVNELMAKQQQLKDIRVTQNSSAEKVQTQIEEERKKFLAVDREVGKLQKEVVSIQTSLEQKRLEKHNLLLDCKVQDIEIILLSGSLDDIIEVEMGTEAESTQATIDIYEKEEAFEIDYSSLKEDLKALQSDQEIEAHLRLLLQQVASQEDILLKTAAPNLRALENLKTVRDKFQESTDAFEASRKEARLCRQEFEQVKKRRYDLFTQCFEHVSISIDQIYKKLCRNNSAQAFLSPENPEEPYLEGISYNCVAPGKRFMPMDNLSGGEKCVAALALLFAVHSFRPAPFFVLDEVDAALDNTNIGKVSSYIKEQTQDQFQMIVISLKEEFYSRADALIGIYPEYDDCMFSRVLTLDLSQYPDTEGQESSKRHGESR

SEQ ID NO: 84688 - protein, 1161 aa, Homo sapiens
  Payload ID: 16843
  Gene Symbol: SMC1B
  Gene Name: structural maintenance of chromosomes 1B
  Uniprot ID: Q8NDV3
  ENSP ID: ENSP00000385902
MAHLELLLVENFKSWRGRQVIGPFRRFTCIIGPNGSGKSNVMDALSFVMGEKIANLRVKNIQELIHGAHIGKPISSSASVKIIYVEESGEEKTFARIIRGGCSEFRFNDNLVSRSVYIAELEKIGIIVKAQNCLVFQGTVESISVKKPKERTQFFEEISTSGELIGEYEEKKRKLQKAEEDAQFNFNKKKNIAAERRQAKLEKEEAERYQSLLEELKMNKIQLQLFQLYHNEKKIHLLNTKLEHVNRDLSVKRESLSHHENIVKARKKEHGMLTRQLQQTEKELKSVETLLNQKRPQYIKAKENTSHHLKKLDVAKKSIKDSEKQCSKQEDDIKALETELADLDAAWRSFEKQIEEEILHKKRDIELEASQLDRYKELKEQVRKKVATMTQQLEKLQWEQKTDEERLAFEKRRHGEVQGNLKQIKEQIEDHKKRIEKLEEYTKTCMDCLKEKKQQEETLVDEIEKTKSRMSEVNEELNLIRSELQNAGIDTHEGKRQQKRAEVLEHLKRLYPDSVFGRLFDLCHPIHKKYQLAVTKVFGRFITAIVVASEKVAKDCIRFLKEERAEPETFLALDYLDIKPINERLRELKGCKMVIDVIKTQFPQLKKVIQFVCGNGLVCETMEEARHIALSGPERQKTVALDGTLFLKSGVISGGSSDLKYKARCWDEKELKNLRDRRSQKIQELKGLMKTLRKETDLKQIQTLIQGTQTRLKYSQNELEMIKKKHLVAFYQEQSQLQSELLNIESQCIMLSEGIKERQRRIKEFQEKIDKVEDDIFQHFCEEIGVENIREFENKHVKRQQEIDQKRLEFEKQKTRLNVQLEYSRSHLKKKLNKINTLKETIQKGSEDIDHLKKAEENCLQTVNELMAKQQQLKDIRVTQNSSAEKVQTQIEEERKKFLAVDREVGKLQKEVVSIQTSLEQKRLEKHNLLLDCKVQDIEIILLSGSLDDIIEVEMGTEAESTQATIDIYEKEEAFEIDYSSLKEDLKALQSDQEIEAHLRLLLQQVASQEDILLKTAAPNLRALENLKTVRDKFQESTDAFEASRKEARLCRQEFEQVKKRRYDLFTQCFEHVSISIDQIYKKLCRNNSAQVSSYIKEQTQDQFQMIVISLKEEFYSRADALIGIYPEYDDCMFSRVLTLDLSQYPDTEGQESSKRHGESR

SEQ ID NO: 84689 - protein, 1197 aa, Homo sapiens
  Payload ID: 16844
  Gene Symbol: SMC2
  Gene Name: structural maintenance of chromosomes 2
  Uniprot ID: O95347
  ENSP ID: ENSP00000286398
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRSLVALSLILSMLLFKPAPIYILDEVDAALDLSHTQNIGQMLRTHFTHSQFIVVSLKEGMFNNANVLFKTKFVDGVSTVARFTQCQNGKISKEAKSKAKPPKGAHVEV

SEQ ID NO: 84690 - protein, 1197 aa, Homo sapiens; identical to SEQ ID NO: 84689
  Payload ID: 16844
  Gene Symbol: SMC2
  Gene Name: structural maintenance of chromosomes 2
  Uniprot ID: O95347
  ENSP ID: ENSP00000363919

SEQ ID NO: 84691 - protein, 1197 aa, Homo sapiens; identical to SEQ ID NO: 84689
  Payload ID: 16844
  Gene Symbol: SMC2
  Gene Name: structural maintenance of chromosomes 2
  Uniprot ID: O95347
  ENSP ID: ENSP00000363925

SEQ ID NO: 84692 - protein, 145 aa, Homo sapiens
  Payload ID: 16844
  Gene Symbol: SMC2
  Gene Name: structural maintenance of chromosomes 2
  ENSP ID: ENSP00000414999
MQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDK

SEQ ID NO: 84693 - protein, 166 aa, Homo sapiens
  Payload ID: 16844
  Gene Symbol: SMC2
  Gene Name: structural maintenance of chromosomes 2
  ENSP ID: ENSP00000431534
MLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRQKQQNHTTG

SEQ ID NO: 84694 - protein, 1217 aa, Homo sapiens
  Payload ID: 16845
  Gene Symbol: SMC3
  Gene Name: structural maintenance of chromosomes 3
  Uniprot ID: Q9UQE7
  ENSP ID: ENSP00000354720
MYIKQVIIQGFRSYRDQTIVDPFSSKHNVIVGRNGSGKSNFFYAIQFVLSDEFSHLRPEQRLALLHEGTGPRVISAFVEIIFDNSDNRLPIDKEEVSLRRVIGAKKDQYFLDKKMVTKNDVMNLLESAGFSRSNPYYIVKQGKINQMATAPDSQRLKLLREVAGTRVYDERKEESISLMKETEGKREKINELLKYIEERLHTLEEEKEELAQYQKWDKMRRALEYTIYNQELNETRAKLDELSAKRETSGEKSRQLRDAQQDARDKMEDIERQVRELKTKISAMKEEKEQLSAERQEQIKQRTKLELKAKDLQDELAGNSEQRKRLLKERQKLLEKIEEKQKELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLFYHIVDSDEVSTKILMEFNKMNLPGEVTFLPLNKLDVRDTAYPETNDAIPMISKLRYNPRFDKAFKHVFGKTLICRSMEVSTQLARAFTMDCITLEGDQVSHRGALTGGYYDTRKSRLELQKDVRKAEEELGELEAKLNENLRRNIERINNEIDQLMNQMQQIETQQRKFKASRDSILSEMKMLKEKRQQSEKTFMPKQRSLQSLEASLHAMESTRESLKAELGTDLLSQLSLEDQKRVDALNDEIRQLQQENRQLLNERIKLEGIITRVETYLNENLRKRLDQVEQELNELRETEGGTVLTATTSELEAINKRVKDTMARSEDLDNSIDKTEAGIKELQKSMERWKNMEKEHMDAINHDTKELEKMTNRQGMLLKKKEECMKKIRELGSLPQEAFEKYQTLSLKQLFRKLEQCNTELKKYSHVNKKALDQFVNFSEQKEKLIKRQEELDRGYKSIMELMNVLELRKYEAIQLTFKQVSKNFSEVFQKLVPGGKATLVMKKGDVEGSQSQDEGEGSGESERGSGSQSSVPSVDQFTGVGIRVSFTGKQGEMREMQQLSGGQKSLVALALIFAIQKCDPAPFYLFDEIDQALDAQHRKAVSDMIMELAVHAQFITTTFRPELLESADKFYGVKFRNKVSHIDVITAEMAKDFVEDDTTHG

SEQ ID NO: 84695 - protein, 1288 aa, Homo sapiens
  Payload ID: 16846
  Gene Symbol: SMC4
  Gene Name: structural maintenance of chromosomes 4
  Uniprot ID: Q9NTJ3
  ENSP ID: ENSP00000341382
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 84696 - protein, 1288 aa, Homo sapiens; identical to SEQ ID NO: 84695
  Payload ID: 16846
  Gene Symbol: SMC4
  Gene Name: structural maintenance of chromosomes 4
  Uniprot ID: Q9NTJ3
  ENSP ID: ENSP00000349961

SEQ ID NO: 84697 - protein, 157 aa, Homo sapiens
  Payload ID: 16846
  Gene Symbol: SMC4
  Gene Name: structural maintenance of chromosomes 4
  ENSP ID: ENSP00000417612
MTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQ

SEQ ID NO: 84698 - protein, 1263 aa, Homo sapiens
  Payload ID: 16846
  Gene Symbol: SMC4
  Gene Name: structural maintenance of chromosomes 4
  ENSP ID: ENSP00000417964
MPRKGTQPSTARRREEGPPPPSPDGASSDAEPEPPSGRTESPATAAAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 84699 - protein, 139 aa, Homo sapiens
  Payload ID: 16846
  Gene Symbol: SMC4
  Gene Name: structural maintenance of chromosomes 4
  ENSP ID: ENSP00000417999
MLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLN

SEQ ID NO: 84700 - protein, 50 aa, Homo sapiens
  Payload ID: 16846
  Gene Symbol: SMC4
  Gene Name: structural maintenance of chromosomes 4
  ENSP ID: ENSP00000418434
MPRKGTQPSTARRREEGPPPPSPDGASSDAEPEPPSGRTESPATAAETAR

SEQ ID NO: 84701 - protein, 173 aa, Homo sapiens
  Payload ID: 16846
  Gene Symbol: SMC4
  Gene Name: structural maintenance of chromosomes 4
  ENSP ID: ENSP00000418820
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGD

SEQ ID NO: 84702 - protein, 170 aa, Homo sapiens
  Payload ID: 16846
  Gene Symbol: SMC4
  Gene Name: structural maintenance of chromosomes 4
  ENSP ID: ENSP00000419247
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDK

SEQ ID NO: 84703 - protein, 119 aa, Homo sapiens
  Payload ID: 16846
  Gene Symbol: SMC4
  Gene Name: structural maintenance of chromosomes 4
  ENSP ID: ENSP00000419360
MLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQT

SEQ ID NO: 84704 - protein, 423 aa, Homo sapiens
  Payload ID: 16846
  Gene Symbol: SMC4
  Gene Name: structural maintenance of chromosomes 4
  ENSP ID: ENSP00000420121
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKE

SEQ ID NO: 84705 - protein, 173 aa, Homo sapiens; identical to SEQ ID NO: 84701
  Payload ID: 16846
  Gene Symbol: SMC4
  Gene Name: structural maintenance of chromosomes 4
  ENSP ID: ENSP00000420644

SEQ ID NO: 84706 - protein, 1230 aa, Homo sapiens
  Payload ID: 16846
  Gene Symbol: SMC4
  Gene Name: structural maintenance of chromosomes 4
  Uniprot ID: Q9NTJ3
  ENSP ID: ENSP00000420734
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 84707 - protein, 180 aa, Homo sapiens
  Payload ID: 16846
  Gene Symbol: SMC4
  Gene Name: structural maintenance of chromosomes 4
  ENSP ID: ENSP00000420817
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPN

SEQ ID NO: 84708 - protein, 1101 aa, Homo sapiens
  Payload ID: 16847
  Gene Symbol: SMC5
  Gene Name: structural maintenance of chromosomes 5
  Uniprot ID: Q8IY18
  ENSP ID: ENSP00000354957
MATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPVTCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTQVPTIPNGHNSSLPMVFQDLPNTLDEIDALLTEERSRASCFTGLNPTIVQEYTKREEEIEQLTEELKGKKVELDQYRENISQVKERWLNPLKELVEKINEKFSNFFSSMQCAGEVDLHTENEEDYDKYGIRIRVKFRSSTQLHELTPHHQSGGERSVSTMLYLMALQELNRCPFRVVDEINQGMDPINERRVFEMVVNTACKENTSQYFFITPKLLQNLPYSEKMTVLFVYNGPHMLEPNTWNLKAFQRRRRRITFTQPS

SEQ ID NO: 84709 - protein, 1091 aa, Homo sapiens
  Payload ID: 16848
  Gene Symbol: SMC6
  Gene Name: structural maintenance of chromosomes 6
  Uniprot ID: Q96SB8
  ENSP ID: ENSP00000323439
MAKRKEENFSSPKNAKRPRQEELEDFDKDGDEDECKGTTLTAAEVGIIESIHLKNFMCHSMLGPFKFGSNVNFVVGNNGSGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEHGKIKREELDVKHALSYNQRQLKELKDSKTDRLKRFGPNVPALLEAIDDAYRQGHFTYKPVGPLGACIHLRDPELALAIESCLKGLLQAYCCHNHADERVLQALMKRFYLPGTSRPPIIVSEFRNEIYDVRHRAAYHPDFPTVLTALEIDNAVVANSLIDMRGIETVLLIKNNSVARAVMQSQKPPKNCREAFTADGDQVFAGRYYSSENTRPKFLSRDVDSEISDLENEVENKTAQILNLQQHLSALEKDIKHNEELLKRCQLHYKELKMKIRKNISEIRELENIEEHQSVDIATLEDEAQENKSKMKMVEEHMEQQKENMEHLKSLKIEAENKYDAIKFKINQLSELADPLKDELNLADSEVDNQKRGKRHYEEKQKEHLDTLNKKKRELDMKEKELEEKMSQARQICPERIEVEKSASILDKEINRLRQKIQAEHASHGDREEIMRQYQEARETYLDLDSKVRTLKKFIKLLGEIMEHRFKTYQQFRRCLTLRCKLYFDNLLSQRAYCGKMNFDHKNETLSISVQPGEGNKAAFNDMRALSGGERSFSTVCFILSLWSIAESPFRCLDEFDVYMDMVNRRIAMDLILKMADSQRFRQFILLTPQSMSSLPSSKLIRILRMSDPERGQTTLPFRPVTQEEDDDQR

SEQ ID NO: 84710 - protein, 445 aa, Homo sapiens
  Payload ID: 16848
  Gene Symbol: SMC6
  Gene Name: structural maintenance of chromosomes 6
  ENSP ID: ENSP00000370672
MAKRKEENFSSPKNAKRPRQEELEDFDKDGDEDECKGTTLTAAEVGIIESIHLKNFMCHSMLGPFKFGSNVNFVVGNNGSGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEH

SEQ ID NO: 84711 - protein, 1091 aa, Homo sapiens; identical to SEQ ID NO: 84709
  Payload ID: 16848
  Gene Symbol: SMC6
  Gene Name: structural maintenance of chromosomes 6
  Uniprot ID: Q96SB8
  ENSP ID: ENSP00000384539

SEQ ID NO: 84712 - protein, 1091 aa, Homo sapiens; identical to SEQ ID NO: 84709
  Payload ID: 16848
  Gene Symbol: SMC6
  Gene Name: structural maintenance of chromosomes 6
  Uniprot ID: Q96SB8
  ENSP ID: ENSP00000404092

SEQ ID NO: 84713 - protein, 740 aa, Homo sapiens
  Payload ID: 16848
  Gene Symbol: SMC6
  Gene Name: structural maintenance of chromosomes 6
  ENSP ID: ENSP00000408644
MAKRKEENFSSPKNAKRPRQEELEDFDKDGDEDECKGTTLTAAEVGIIESIHLKNFMCHSMLGPFKFGSNVNFVVGNNGSWSAVVRSRLNATSASQVQAILLFQPCGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEHGKIKREELDVKHALSYNQRQLKELKDSKTDRLKRFGPNVPALLEAIDDAYRQGHFTYKPVGPLGACIHLRDPELALAIESCLKGLLQAYCCHNHADERVLQALMKRFYLPGTSRPPIIVSEFRNEIYDVRHRAAYHPDFPTVLTALEIDNAVVANSLIDMRGIETVLLIKNNSVARAVMQSQKPPKNCREAFTADGDQVFAGRYYSSENTRPKFLSRDVDSEISDLENEVENKTAQILNLQQHLSALEKDIKHNEELLKRCQLHYKELK

SEQ ID NO: 84714 - protein, 22 aa, Homo sapiens
  Payload ID: 16848
  Gene Symbol: SMC6
  Gene Name: structural maintenance of chromosomes 6
  ENSP ID: ENSP00000412246
YDVRHRTKENSPGHSGGACSVN

SEQ ID NO: 84715 - protein, 57 aa, Homo sapiens
  Payload ID: 16848
  Gene Symbol: SMC6
  Gene Name: structural maintenance of chromosomes 6
  ENSP ID: ENSP00000415352
MAKRKEENFSSPKNAKRPRQEELEDFDKDGDEDECKGTTLTAAEVGIIESIHLKNFM

SEQ ID NO: 84716 - protein, 76 aa, Homo sapiens
  Payload ID: 16848
  Gene Symbol: SMC6
  Gene Name: structural maintenance of chromosomes 6
  ENSP ID: ENSP00000480257
MAKRKEENFSSPKNAKRPRQEELEDFDKDGDEDECKGTTLTAAEVGIIESIHLKNFMCHSMLGPFKFGSNVNFVVG

SEQ ID NO: 84717 - protein, 2005 aa, Homo sapiens
  Payload ID: 16849
  Gene Symbol: SMCHD1
  Gene Name: structural maintenance of chromosomes flexible hinge domain containing 1
  Uniprot ID: A6NHR9
  ENSP ID: ENSP00000326603
MAAADGGGPGGASVGTEEDGGGVGHRTVYLFDRREKESELGDRPLQVGERSDYAGFRACVCQTLGISPEEKFVITTTSRKEITCDNFDETVKDGVTLYLLQSVNQLLLTATKERIDFLPHYDTLVKSGMYEYYASEGQNPLPFALAELIDNSLSATSRNIGVRRIQIKLLFDETQGKPAVAVIDNGRGMTSKQLNNWAVYRLSKFTRQGDFESDHSGYVRPVPVPRSLNSDISYFGVGGKQAVFFVGQSARMISKPADSQDVHELVLSKEDFEKKEKNKEAIYSGYIRNRKPSDSVHITNDDERFLHHLIIEEKEKDSFTAVVITGVQPEHIQYLKNYFHLWTRQLAHIYHYYIHGPKGNEIRTSKEVEPFNNIDIEISMFEKGKVPKIVNLREIQDDMQTLYVNTAADSFEFKAHVEGDGVVEGIIRYHPFLYDRETYPDDPCFPSKLKDEDDEDDCFILEKAARGKRPIFECFWNGRLIPYTSVEDFDWCTPPKKRGLAPIECYNRISGALFTNDKFQVSTNKLTFMDLELKLKDKNTLFTRILNGQEQRMKIDREFALWLKDCHEKYDKQIKFTLFKGVITRPDLPSKKQGPWATYAAIEWDGKIYKAGQLVKTIKTLPLFYGSIVRFFLYGDHDGEVYATGGEVQIAMEPQALYDEVRTVPIAKLDRTVAEKAVKKYVEDEMARLPDRLSVTWPEGDELLPNEVRPAGTPIGALRIEILNKKGEAMQKLPGTSHGGSKKLLVELKVILHSSSGNKEIISHISQHGGKWPYWFKKMENIQKLGNYTLKLQVVLNESNADTYAGRPLPSKAIKFSVKEGKPEKFSFGLLDLPFRVGVPFNIPLEFQDEFGHTSQLVTDIQPVLEASGLSLHYEEITKGPNCVIRGVTAKGPVNSCQGKNYNLKVTLPGLKEDSQILKIRLLPGHPRRLKVKPDSEILVIENGTAFPFQVEVLDESDNITAQPKLIVHCKFSGAPNLPVYVVDCSSSGTSILTGSAIQVQNIKKDQTLKARIEIPSCKDVAPVEKTIKLLPSSHVARLQIFSVEGQKAIQIKHQDEVNWIAGDIMHNLIFQMYDEGEREINITSALAEKIKVNWTPEINKEHLLQGLLPDVQVPTSVKDMRYCQVSFQDDHVSLESAFTVRPLPDEPKHLKCEMKGGKTVQMGQELQGEVVIIITDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKLMPSNQQHKTDEKGRANLGVFSVFAPRGEHTLQVKAIYNKSIIEGPIIKLMILPDPEKPVRLNVKYDKDASFLAGGLFTDFMISVISEDDSIIKNINPARISMKMWKLSTSGNRPPANAETFSCNKIKDNDKEDGCFYFRDKVIPNKVGTYCIQFGFMMDKTNILNSEQVIVEVLPNQPVKLVPKIKPPTPAVSNVRSVASRTLVRDLHLSITDDYDNHTGIDLVGTIIATIKGSNEEDTDTPLFIGKVRTLEFPFVNGSAEIMSLVLAESSPGRDSTEYFIVFEPRLPLLSRTLEPYILPFMFYNDVKKQQQMAALTKEKDQLSQSIVMYKSLFEASQQLLNEMKCQVEEARLKEAQLRNELKIHNIDIPTTQQVPHIEALLKRKLSEQEELKKKPRRSCTLPNYTKGSGDVLGKIAHLAQIEDDRAAMVISWHLASDMDCVVTLTTDAARRIYDETQGRQQVLPLDSIYKKTLPDWKRSLPHFRNGKLYFKPIGDPVFARDLLTFPDNVEHCETVFGMLLGDTIILDNLDAANHYRKEVVKITHCPTLLTRDGDRIRSNGKFGGLQNKAPPMDKLRGMVFGAPVPKQCLILGEQIDLLQQYRSAVCKLDSVNKDLNSQLEYLRTPDMRKKKQELDEHEKNLKLIEEKLGMTPIRKCNDSLRHSPKVETTDCPVPPKRMRREATRQNRIITKTDV

SEQ ID NO: 84718 - protein, 49 aa, Homo sapiens
  Payload ID: 16849
  Gene Symbol: SMCHD1
  Gene Name: structural maintenance of chromosomes flexible hinge domain containing 1
  ENSP ID: ENSP00000462050
  MOD_RES (1)..(1): Any amino acid
XIECYNRISGALFTNDKFQVSTNKLTFMDLELKLKDKNTLFTRILNGQV

SEQ ID NO: 84719 - protein, 48 aa, Homo sapiens
  Payload ID: 16849
  Gene Symbol: SMCHD1
  Gene Name: structural maintenance of chromosomes flexible hinge domain containing 1
  ENSP ID: ENSP00000463036
  MOD_RES (1)..(1): Any amino acid
XKLGMTPIRKCNDSLRHSPKVETTDCPVPPKRMRREATRQNRDGVLLC

SEQ ID NO: 84720 - protein, 1388 aa, Homo sapiens
  Payload ID: 16849
  Gene Symbol: SMCHD1
  Gene Name: structural maintenance of chromosomes flexible hinge domain containing 1
  ENSP ID: ENSP00000463049
DLELKLKDKNTLFTRILNGQEQRMKIDREFALWLKDCHEKYDKQIKFTLFKGVITRPDLPSKKQGPWATYAAIEWDGKIYKAGQLVKTIKTLPLFYGSIVRFFLYGDHDGEVYATGGEVQIAMEPQALYDEVRTVPIAKLDRTVAEKAVKKYVEDEMARLPDRLSVTWPEGDELLPNEVRPAGTPIGALRIEILNKKGEAMQKLPGTSHGGSKKLLVELKVILHSSSGNKEIISHISQHGGKWPYWFKKMENIQKLGNYTLKLQVVLNESNADTYAGRPLPSKAIKFSVKEGKPEKFSFGLLDLPFRVGVPFNIPLEFQDEFGHTSQLVTDIQPVLEASGLSLHYEEITKGPNCVIRGVTAKGPVNSCQGKNYNLKVTLPGLKEDSQILKIRLLPGHPRRLKVKPDSEILVIENGTAFPFQVEVLDESDNITAQPKLIVHCKFSGAPNLPVYVVDCSSSGTSILTGSAIQVQNIKKDQTLKARIEIPSCKDVAPVEKTIKLLPSSHVARLQIFSVEGQKAIQIKHQDEVNWIAGDIMHNLIFQMYDEGEREINITSALAEKIKVNWTPEINKEHLLQGLLPDVQVPTSVKDMRYCQVSFQDDHVSLESAFTVRPLPDEPKHLKCEMKGGKTVQMGQELQGEVVIIITDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKLMPSNQQHKTDEKGRANLGVFSVFAPRGEHTLQVKAIYNKSIIEGPIIKLMILPDPEKPVRLNVKYDKDASFLAGGLFTDFMISVISEDDSIIKNINPARISMKMWKLSTSGNRPPANAETFSCNKIKDNDKEDGCFYFRDKVIPNKVGTYCIQFGFMMDKTNILNSEQVIVEVLPNQPVKLVPKIKPPTPAVSNVRSVASRTLVRDLHLSITDDYDNHTGIDLVGTIIATIKGSNEEDTDTPLFIGKVRTLEFPFVNGSAEIMSLVLAESSPGRDSTEYFIVFEPRLPLLSRTLEPYILPFMFYNDVKKQQQMAALTKEKDQLSQSIVMYKSLFEASQQLLNEMKCQVEEARLKEAQLRNELKIHNIDIPTTQQVPHIEALLKRKLSEQEELKKKPRRSCTLPNYTKGSGDVLGKIAHLAQIEDDRAAMVISWHLASDMDCVVTLTTDAARRIYDETQGRQQVLPLDSIYKKTLPDWKRSLPHFRNGKLYFKPIGDPVFARDLLTFPDNVEHCETVFGMLLGDTIILDNLDAANHYRKEVVKITHCPTLLTRDGDRIRSNGKFGGLQNKAPPMDKLRGMVFGAPVPKQCLILGEQIVHACVPSYSGG

SEQ ID NO: 84721 - protein, 150 aa, Homo sapiens
  Payload ID: 16849
  Gene Symbol: SMCHD1
  Gene Name: structural maintenance of chromosomes flexible hinge domain containing 1
  ENSP ID: ENSP00000464684
  MOD_RES (1)..(1): Any amino acid
XKYVEDEMARLPDRLSVTWPEGDELLPNEVRPAGTPIGALRIEILNKKGEAMQKLPGTSHGGSKKLLVELKVILHSSSGNKEIISHISQHGGKWPYWFKKMENIQKLGNYTLKLQVVLNESNADTYAGRPLPSKAIKFSVKVVYLYIMKK

SEQ ID NO: 84722 - protein, 709 aa, Homo sapiens
  Payload ID: 16850
  Gene Symbol: SSRP1
  Gene Name: structure specific recognition protein 1
  Uniprot ID: Q08945
  ENSP ID: ENSP00000278412
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 84723 - protein, 173 aa, Homo sapiens
  Payload ID: 16850
  Gene Symbol: SSRP1
  Gene Name: structure specific recognition protein 1
  ENSP ID: ENSP00000431154
MEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRY

SEQ ID NO: 84724 - protein, 89 aa, Homo sapiens
  Payload ID: 16850
  Gene Symbol: SSRP1
  Gene Name: structure specific recognition protein 1
  ENSP ID: ENSP00000434546
MEKDLCVKGWNWGTVKFGGQLLSFDIGDQPVFEIPLSNVSQCTTGKNEVTLEFHQNDDAEVSLMEVRFYVPPTQEDGVDPVEAFAQNVL

SEQ ID NO: 84725 - protein, 225 aa, Homo sapiens
  Payload ID: 16850
  Gene Symbol: SSRP1
  Gene Name: structure specific recognition protein 1
  ENSP ID: ENSP00000489564
  MOD_RES (1)..(1): Any amino acid
XEEYGKLFDFVNAKKLNIKNRGLKEKKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKK

SEQ ID NO: 84726 - protein, 705 aa, Homo sapiens
  Payload ID: 16851
  Gene Symbol: STT3A
  Gene Name: STT3A, subunit of the oligosaccharyltransferase complex (catalytic)
  Uniprot ID: P46977
  ENSP ID: ENSP00000376472
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 84727 - protein, 613 aa, Homo sapiens
  Payload ID: 16851
  Gene Symbol: STT3A
  Gene Name: STT3A, subunit of the oligosaccharyltransferase complex (catalytic)
  Uniprot ID: P46977
  ENSP ID: ENSP00000432820
MITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 84728 - protein, 117 aa, Homo sapiens
  Payload ID: 16851
  Gene Symbol: STT3A
  Gene Name: STT3A, subunit of the oligosaccharyltransferase complex (catalytic)
  ENSP ID: ENSP00000432912
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCV

SEQ ID NO: 84729 - protein, 102 aa, Homo sapiens
  Payload ID: 16851
  Gene Symbol: STT3A
  Gene Name: STT3A, subunit of the oligosaccharyltransferase complex (catalytic)
  ENSP ID: ENSP00000435810
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHV

SEQ ID NO: 84730 - protein, 194 aa, Homo sapiens
  Payload ID: 16851
  Gene Symbol: STT3A
  Gene Name: STT3A, subunit of the oligosaccharyltransferase complex (catalytic)
  ENSP ID: ENSP00000436523
  MOD_RES (1)..(1): Any amino acid
XYCLGTILSMQISFVGFQPVLSSEHMAAFGVFGLCQIHAFVDYLRSKLNPQQFEVLFRSVISLEKYLPGRGVSTRCWIPLMLRTTSPSLLLCLSISPQPGPHTILTCSSSSSCFQVRLMLVLAPVMCILSGIGVSQVLSTYMKNLDISRPDKKSKKQQDSTYPIKNEVASGMILVMAFFLITYTFHSTWVTSEA

SEQ ID NO: 84731 - protein, 119 aa, Homo sapiens
  Payload ID: 16851
  Gene Symbol: STT3A
  Gene Name: STT3A, subunit of the oligosaccharyltransferase complex (catalytic)
  ENSP ID: ENSP00000436558
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFL

SEQ ID NO: 84732 - protein, 705 aa, Homo sapiens; identical to SEQ ID NO: 84726
  Payload ID: 16851
  Gene Symbol: STT3A
  Gene Name: STT3A, subunit of the oligosaccharyltransferase complex (catalytic)
  Uniprot ID: P46977
  ENSP ID: ENSP00000436962

SEQ ID NO: 84733 - protein, 826 aa, Homo sapiens
  Payload ID: 16852
  Gene Symbol: STT3B
  Gene Name: STT3B, subunit of the oligosaccharyltransferase complex (catalytic)
  Uniprot ID: Q8TCJ2
  ENSP ID: ENSP00000295770
MAEPSAPESKHKSSLNSSPWSGLMALGNSRHGHHGPGAQCAHKAAGGAAPPKPAPAGLSGGLSQPAGWQSLLSFTILFLAWLAGFSSRLFAVIRFESIIHEFDPWFNYRSTHHLASHGFYEFLNWFDERAWYPLGRIVGGTVYPGLMITAGLIHWILNTLNITVHIRDVCVFLAPTFSGLTSISTFLLTRELWNQGAGLLAACFIAIVPGYISRSVAGSFDNEGIAIFALQFTYYLWVKSVKTGSVFWTMCCCLSYFYMVSAWGGYVFIINLIPLHVFVLLLMQRYSKRVYIAYSTFYIVGLILSMQIPFVGFQPIRTSEHMAAAGVFALLQAYAFLQYLRDRLTKQEFQTLFFLGVSLAAGAVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSNVFEHYLGDDMKRENPPVEDSSDEDDKRNQGNLYDKAGKVRKHATEQEKTEEGLGPNIKSIVTMLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 84734 - protein, 382 aa, Homo sapiens
  Payload ID: 16853
  Gene Symbol: STX16-NPEPL1
  Gene Name: STX16-NPEPL1 readthrough (NMD candidate)
  ENSP ID: ENSP00000457522
MATRRLTDAFLLLRNNSIQNRQLLAEQVSSHITSSPLHSRSIAAELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKDFSHVEGLLSQSLRLWKSYYICQGMALVSHPLGRSSSCLSPLECRVPVCNVFANRKKSERSSYTLACSVPGTGGKKNNKKSKRPAFRMLKL

SEQ ID NO: 84735 - protein, 127 aa, Homo sapiens
  Payload ID: 16854
  Gene Symbol: SUB1
  Gene Name: SUB1 homolog, transcriptional regulator
  Uniprot ID: P53999
  ENSP ID: ENSP00000265073
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 84736 - protein, 127 aa, Homo sapiens; identical to SEQ ID NO: 84735
  Payload ID: 16854
  Gene Symbol: SUB1
  Gene Name: SUB1 homolog, transcriptional regulator
  Uniprot ID: P53999
  ENSP ID: ENSP00000422078

SEQ ID NO: 84737 - protein, 127 aa, Homo sapiens; identical to SEQ ID NO: 84735
  Payload ID: 16854
  Gene Symbol: SUB1
  Gene Name: SUB1 homolog, transcriptional regulator
  Uniprot ID: P53999
  ENSP ID: ENSP00000422806

SEQ ID NO: 84738 - protein, 84 aa, Homo sapiens
  Payload ID: 16854
  Gene Symbol: SUB1
  Gene Name: SUB1 homolog, transcriptional regulator
  ENSP ID: ENSP00000423356
MPKSKELVSSSSSGSDSDSEVDKKLKRKKQVAPEKPVKKQKTGETSRALSSSKQSSSSRDDNMFQELFITFITGVPPAQEVSGV

SEQ ID NO: 84739 - protein, 65 aa, Homo sapiens
  Payload ID: 16854
  Gene Symbol: SUB1
  Gene Name: SUB1 homolog, transcriptional regulator
  ENSP ID: ENSP00000423893
MPKSKELVSSSSSGSDSDSEVDKKLKRKKQVAPEKPVKKQKTGETSRALSSSKQSSSSRDDNMFQ

SEQ ID NO: 84740 - protein, 127 aa, Homo sapiens; identical to SEQ ID NO: 84735
  Payload ID: 16854
  Gene Symbol: SUB1
  Gene Name: SUB1 homolog, transcriptional regulator
  Uniprot ID: P53999
  ENSP ID: ENSP00000426850

SEQ ID NO: 84741 - protein, 127 aa, Homo sapiens; identical to SEQ ID NO: 84735
  Payload ID: 16854
  Gene Symbol: SUB1
  Gene Name: SUB1 homolog, transcriptional regulator
  Uniprot ID: P53999
  ENSP ID: ENSP00000427100

SEQ ID NO: 84742 - protein, 134 aa, Homo sapiens
  Payload ID: 16855
  Gene Symbol: SMR3A
  Gene Name: submaxillary gland androgen regulated protein 3A
  Uniprot ID: Q99954
  ENSP ID: ENSP00000226460
MKSLTWILGLWALAACFTPGESQRGPRGPYPPGPLAPPPPPCFPFGTGFVPPPHPPPYGPGRFPPPLSPPYGPGRIPPSPPPPYGPGRIQSHSLPPPYGPGYPQPPSQPRPYPPGPPFFPVNSPTDPALPTPAP

SEQ ID NO: 84743 - protein, 79 aa, Homo sapiens
  Payload ID: 16856
  Gene Symbol: SMR3B
  Gene Name: submaxillary gland androgen regulated protein 3B
  Uniprot ID: P02814
  ENSP ID: ENSP00000302400
MKSLTWILGLWALAACFTPGESQRGPRGPYPPGPLAPPQPFGPGFVPPPPPPPYGPGRIPPPPPAPYGPGIFPPPPPQP

SEQ ID NO: 84744 - protein, 79 aa, Homo sapiens; identical to SEQ ID NO: 84743
  Payload ID: 16856
  Gene Symbol: SMR3B
  Gene Name: submaxillary gland androgen regulated protein 3B
  Uniprot ID: P02814
  ENSP ID: ENSP00000423138

SEQ ID NO: 84745 - protein, 79 aa, Homo sapiens; identical to SEQ ID NO: 84743
  Payload ID: 16856
  Gene Symbol: SMR3B
  Gene Name: submaxillary gland androgen regulated protein 3B
  Uniprot ID: P02814
  ENSP ID: ENSP00000481313

SEQ ID NO: 84746 - protein, 115 aa, Homo sapiens
  Payload ID: 16857
  Gene Symbol: SDHAF1
  Gene Name: succinate dehydrogenase complex assembly factor 1
  Uniprot ID: A6NFY7
  ENSP ID: ENSP00000368165
MSRHSRLQRQVLSLYRDLLRAGRGKPGAEARVRAEFRQHAGLPRSDVLRIEYLYRRGRRQLQLLRSGHATAMGAFVRPRAPTGEPGGVGCQPDDGDSPRNPHDSTGAPETRPDGR

SEQ ID NO: 84747 - protein, 166 aa, Homo sapiens
  Payload ID: 16858
  Gene Symbol: SDHAF2
  Gene Name: succinate dehydrogenase complex assembly factor 2
  Uniprot ID: Q9NX18
  ENSP ID: ENSP00000301761
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATEAKPAPEIFENEVMALLRDFAKNKNKEQRLRAPDLEYLFEKPR

SEQ ID NO: 84748 - protein, 129 aa, Homo sapiens
  Payload ID: 16858
  Gene Symbol: SDHAF2
  Gene Name: succinate dehydrogenase complex assembly factor 2
  ENSP ID: ENSP00000352630
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGWSAMA

SEQ ID NO: 84749 - protein, 65 aa, Homo sapiens
  Payload ID: 16858
  Gene Symbol: SDHAF2
  Gene Name: succinate dehydrogenase complex assembly factor 2
  ENSP ID: ENSP00000439983
MAVSTVFSTSSLGIGLFVAVGSVSPSGKEDLGFPTPPSSPLAEVTTLTSYLDKLSTSLDWEPLGD

SEQ ID NO: 84750 - protein, 88 aa, Homo sapiens
  Payload ID: 16858
  Gene Symbol: SDHAF2
  Gene Name: succinate dehydrogenase complex assembly factor 2
  ENSP ID: ENSP00000443660
MAVSTVFSTSSLMLALSRHSLLSPLLSVTSFRRFYRGDSPTDSQKDMIEIPLPPWQERTDESIETKRARLLYESRKRGMLENCILLRS

SEQ ID NO: 84751 - protein, 28 aa, Homo sapiens
  Payload ID: 16858
  Gene Symbol: SDHAF2
  Gene Name: succinate dehydrogenase complex assembly factor 2
  ENSP ID: ENSP00000469670
MAVSTVFSTSSLKLNQPQKYLKMKSWPC

SEQ ID NO: 84752 - protein, 133 aa, Homo sapiens
  Payload ID: 16858
  Gene Symbol: SDHAF2
  Gene Name: succinate dehydrogenase complex assembly factor 2
  ENSP ID: ENSP00000469951
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGSSDSPASAS

SEQ ID NO: 84753 - protein, 141 aa, Homo sapiens
  Payload ID: 16858
  Gene Symbol: SDHAF2
  Gene Name: succinate dehydrogenase complex assembly factor 2
  ENSP ID: ENSP00000471030
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGTGYDKQHNVKIGQFRLI

SEQ ID NO: 84754 - protein, 65 aa, Homo sapiens; identical to SEQ ID NO: 84749
  Payload ID: 16858
  Gene Symbol: SDHAF2
  Gene Name: succinate dehydrogenase complex assembly factor 2
  ENSP ID: ENSP00000471120

SEQ ID NO: 84755 - protein, 68 aa, Homo sapiens
  Payload ID: 16859
  Gene Symbol: SDHAF3
  Gene Name: succinate dehydrogenase complex assembly factor 3
  ENSP ID: ENSP00000353548
MPGRHVSRVRALYKRVLQLHRVLPPDLKSLGDQYVKDEFRRHKTVGSDEAQRFLQEWEGMSRNLDACI

SEQ ID NO: 84756 - protein, 125 aa, Homo sapiens
  Payload ID: 16859
  Gene Symbol: SDHAF3
  Gene Name: succinate dehydrogenase complex assembly factor 3
  Uniprot ID: Q9NRP4
  ENSP ID: ENSP00000414066
MPGRHVSRVRALYKRVLQLHRVLPPDLKSLGDQYVKDEFRRHKTVGSDEAQRFLQEWEVYATALLQQANENRQNSTGKACFGTFLPEEKLNDFRDEQIGQLQELMQEATKPNRQFSISESMKPKF

SEQ ID NO: 84757 - protein, 108 aa, Homo sapiens
  Payload ID: 16860
  Gene Symbol: SDHAF4
  Gene Name: succinate dehydrogenase complex assembly factor 4
  Uniprot ID: Q5VUM1
  ENSP ID: ENSP00000359505
MTPSRLPWLLSWVSATAWRAARSPLLCHSLRKTSSSQGGKSELVKQSLKKPKLPEGRFDAPEDSHLEKEPLEKFPDDVNPVTKEKGGPRGPEPTRYGDWERKGRCIDF

SEQ ID NO: 84758 - protein, 664 aa, Homo sapiens
  Payload ID: 16861
  Gene Symbol: SDHA
  Gene Name: succinate dehydrogenase complex, subunit A, flavoprotein (Fp)
  Uniprot ID: P31040
  ENSP ID: ENSP00000264932
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 84759 - protein, 101 aa, Homo sapiens
  Payload ID: 16861
  Gene Symbol: SDHA
  Gene Name: succinate dehydrogenase complex, subunit A, flavoprotein (Fp)
  ENSP ID: ENSP00000421911
GMVWNTDLVETLELQNLMLCALQTIYGAEARKESRGAHAREDYKSNKKRDGVSGLRCGLMSTITPSPSRGNRRSPLRSTGGSTPCPMWTLALGRSLWNIDP

SEQ ID NO: 84760 - protein, 126 aa, Homo sapiens
  Payload ID: 16861
  Gene Symbol: SDHA
  Gene Name: succinate dehydrogenase complex, subunit A, flavoprotein (Fp)
  ENSP ID: ENSP00000422404
  MOD_RES (1)..(1): Any amino acid
XNRLGANSLLDLVVFGRACALSIEESCRPGDKVPPIKPNAGEESVMNLDKLRFADGSIRTSELRLSMQKSNKKRDGVSGLRCGLMSTITPSPSRGNRRSPLRSTGGSTPCPMWTLALGRSLWNIDP

SEQ ID NO: 84761 - protein, 89 aa, Homo sapiens
  Payload ID: 16861
  Gene Symbol: SDHA
  Gene Name: succinate dehydrogenase complex, subunit A, flavoprotein (Fp)
  ENSP ID: ENSP00000425077
MSGVRGLSRLLSARRLALAKACTDTACKLFESSLIRGKRKPRNFNSYWLTAYFSGQQCCKQEPEVFTSLLMGTRGHLLKFQIPFLLSIQ

SEQ ID NO: 84762 - protein, 583 aa, Homo sapiens
  Payload ID: 16861
  Gene Symbol: SDHA
  Gene Name: succinate dehydrogenase complex, subunit A, flavoprotein (Fp)
  ENSP ID: ENSP00000426514
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKVRIDEYDYSKPIQGQQKKPFEEHWRKHTLSYVDVGTGKVTLEYRPVIDKTLNEADCATVPPAIRSY

SEQ ID NO: 84763 - protein, 616 aa, Homo sapiens
  Payload ID: 16861
  Gene Symbol: SDHA
  Gene Name: succinate dehydrogenase complex, subunit A, flavoprotein (Fp)
  Uniprot ID: P31040
  ENSP ID: ENSP00000427703
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQLENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 84764 - protein, 519 aa, Homo sapiens
  Payload ID: 16861
  Gene Symbol: SDHA
  Gene Name: succinate dehydrogenase complex, subunit A, flavoprotein (Fp)
  ENSP ID: ENSP00000484230
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 84765 - protein, 280 aa, Homo sapiens
  Payload ID: 16862
  Gene Symbol: SDHB
  Gene Name: succinate dehydrogenase complex, subunit B, iron sulfur (Ip)
  Uniprot ID: P21912
  ENSP ID: ENSP00000364649
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 84766 - protein, 200 aa, Homo sapiens
  Payload ID: 16862
  Gene Symbol: SDHB
  Gene Name: succinate dehydrogenase complex, subunit B, iron sulfur (Ip)
  ENSP ID: ENSP00000480482
MFNLTLVHYKASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQ

SEQ ID NO: 84767 - protein, 123 aa, Homo sapiens
  Payload ID: 16862
  Gene Symbol: SDHB
  Gene Name: succinate dehydrogenase complex, subunit B, iron sulfur (Ip)
  ENSP ID: ENSP00000481376
MQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKL

SEQ ID NO: 84768 - protein, 150 aa, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENSP ID: ENSP00000356952
MAALLLRHVGRHCLRAHFSPQLCIRNAVPLGTTAKEEMERFWNKNIGSNRPLSPHITIYSWSLPMAMSICHRGTGIALSADVGPRKRPEDSPAIPVWSGCPGSYCVVLYGAGSHVKKGGSQHHLPTHYYIHPSFCLSFLSPAWEKFSLFV

SEQ ID NO: 84769 - protein, 169 aa, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENSP ID: ENSP00000356953
MAALLLRHVGRHCLRAHFSPQLCIRNAVPLGTTAKEEMERFWNKNIGSNRPLSPHITIYSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 84770 - protein, 116 aa, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENSP ID: ENSP00000376009
MAALLLSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 84771 - protein, 135 aa, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENSP ID: ENSP00000390558
MAALLLRHVGRHCLRAHFSPQLCIRNWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 84772 - protein, 116 aa, Homo sapiens
  Payload ID: 16863
  Gene Symbol: SDHC
  Gene Name: succinate dehydrogenase complex, subunit C, integral membrane protein, 15kDa
  Uniprot ID: Q99643
  ENSP ID: ENSP00000423260
MAALLLRHVGRHCLRAHFSPQLCIRNWSLPMAMSICHRGTGIALSADVGPRKRPEDSPAIPVWSGCPGSYCVVLYGAGSHVKKGGSQHHLPTHYYIHPSFCLSFLSPAWEKFSLFV

SEQ ID NO: 84773 - protein, 67 aa, Homo sapiens
  Payload ID: 16863
  Gene Symbol: SDHC
  Gene Name: succinate dehydrogenase complex, subunit C, integral membrane protein, 15kDa
  ENSP ID: ENSP00000423929
MAALLLRHVGRHCLRAHFSPQLCIRNAVPLGTTAKEEMERFWNKNIGSNRPLSPHITIYSPISDAVW

SEQ ID NO: 84774 - protein, 32 aa, Homo sapiens
  Payload ID: 16863
  Gene Symbol: SDHC
  Gene Name: succinate dehydrogenase complex, subunit C, integral membrane protein, 15kDa
  ENSP ID: ENSP00000482902
  MOD_RES (1)..(1): Any amino acid
XHVGRHCLRAHFSPQLCIRKVSFCRPGWSVVA

SEQ ID NO: 84775 - protein, 159 aa, Homo sapiens
  Payload ID: 16864
  Gene Symbol: SDHD
  Gene Name: succinate dehydrogenase complex, subunit D, integral membrane protein
  Uniprot ID: O14521
  ENSP ID: ENSP00000364699
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGQVVTDYVHGDALQKAAKAGLLALSALTFAGLCYFNYHDVGICKAVAMLWKL

SEQ ID NO: 84776 - protein, 143 aa, Homo sapiens
  Payload ID: 16864
  Gene Symbol: SDHD
  Gene Name: succinate dehydrogenase complex, subunit D, integral membrane protein
  Uniprot ID: O14521
  ENSP ID: ENSP00000432005
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWLECNGAILARHDLGSARSQLTATSAFRVQAILLPQPPK

SEQ ID NO: 84777 - protein, 104 aa, Homo sapiens
  Payload ID: 16864
  Gene Symbol: SDHD
  Gene Name: succinate dehydrogenase complex, subunit D, integral membrane protein
  ENSP ID: ENSP00000432465
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGH

SEQ ID NO: 84778 - protein, 101 aa, Homo sapiens
  Payload ID: 16864
  Gene Symbol: SDHD
  Gene Name: succinate dehydrogenase complex, subunit D, integral membrane protein
  ENSP ID: ENSP00000432946
  MOD_RES (1)..(1): Any amino acid
XWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGH

SEQ ID NO: 84779 - protein, 55 aa, Homo sapiens
  Payload ID: 16864
  Gene Symbol: SDHD
  Gene Name: succinate dehydrogenase complex, subunit D, integral membrane protein
  ENSP ID: ENSP00000433202
  MOD_RES (1)..(1): Any amino acid
XGSKAASLHWTSERVVSVLLLGLLPAAYLNPCSAMDYSLAAALTLHGHWKIKNNE

SEQ ID NO: 84780 - protein, 131 aa, Homo sapiens
  Payload ID: 16864
  Gene Symbol: SDHD
  Gene Name: succinate dehydrogenase complex, subunit D, integral membrane protein
  ENSP ID: ENSP00000435475
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGALDKLLLTMFMGMPCRKLPRQGFWHFQL

SEQ ID NO: 84781 - protein, 85 aa, Homo sapiens
  Payload ID: 16864
  Gene Symbol: SDHD
  Gene Name: succinate dehydrogenase complex, subunit D, integral membrane protein
  Uniprot ID: O14521
  ENSP ID: ENSP00000436217
MAVLWRLSAVCGALGGRALLLRTPVVRPAHISAFLQDRPIPEWCGVQHIHLSPSHHWALDKLLLTMFMGMPCRKLPRQGFWHFQL

SEQ ID NO: 84782 - protein, 120 aa, Homo sapiens
  Payload ID: 16864
  Gene Symbol: SDHD
  Gene Name: succinate dehydrogenase complex, subunit D, integral membrane protein
  Uniprot ID: O14521
  ENSP ID: ENSP00000436669
MAVLWRLSAVCGALGGRAGSKAASLHWTSERVVSVLLLGLLPAAYLNPCSAMDYSLAAALTLHGHWGLGQVVTDYVHGDALQKAAKAGLLALSALTFAGLCYFNYHDVGICKAVAMLWKL

SEQ ID NO: 84783 - protein, 143 aa, Homo sapiens; identical to SEQ ID NO: 84776
  Payload ID: 16864
  Gene Symbol: SDHD
  Gene Name: succinate dehydrogenase complex, subunit D, integral membrane protein
  Uniprot ID: O14521
  ENSP ID: ENSP00000480666

SEQ ID NO: 84784 - protein, 334 aa, Homo sapiens
  Payload ID: 16865
  Gene Symbol: SUCNR1
  Gene Name: succinate receptor 1
  Uniprot ID: Q9BXA5
  ENSP ID: ENSP00000355156
MLGIMAWNATCKNWLAAEAALEKYYLSIFYGIEFVVGVLGNTIVVYGYIFSLKNWNSSNIYLFNLSVSDLAFLCTLPMLIRSYANGNWIYGDVLCISNRYVLHANLYTSILFLTFISIDRYLIIKYPFREHLLQKKEFAILISLAIWVLVTLELLPILPLINPVITDNGTTCNDFASSGDPNYNLIYSMCLTLLGFLIPLFVMCFFYYKIALFLKQRNRQVATALPLEKPLNLVIMAVVIFSVLFTPYHVMRNVRIASRLGSWKQYQCTQVVINSFYIVTRPLAFLNSVINPVFYFLLGDHFRDMLMNQLRHNFKSLTSFSRWAHELLLSFREK

SEQ ID NO: 84785 - protein, 463 aa, Homo sapiens
  Payload ID: 16866
  Gene Symbol: SUCLA2
  Gene Name: succinate-CoA ligase, ADP-forming, beta subunit
  Uniprot ID: Q9P2R7
  ENSP ID: ENSP00000367923
MAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDKKVLAILVNIFGGIMRCDVIAQGIVMAVKDLEIKIPVVVRLQGTRVDDAKALIADSGLKILACDDLDEAARMVVKLSEIVTLAKQAHVDVKFQLPI

SEQ ID NO: 84786 - protein, 298 aa, Homo sapiens
  Payload ID: 16866
  Gene Symbol: SUCLA2
  Gene Name: succinate-CoA ligase, ADP-forming, beta subunit
  ENSP ID: ENSP00000392771
SGRGHPSEPPASDGPAGCCSGSKDVVIKAQVLAGGRGKGTFESGLKGGVKIVFSPEEAKAVSSQMIGKKLFTKQTGEKGRICNQVLVCERKYPRREYYFAITMERSFQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDKDAAKANLNYIGLDGNIGCLVNGAGLAMATMDIIKLHGGTPANFLDVGGGATVHQVTEAFKLITSDK

SEQ ID NO: 84787 - protein, 154 aa, Homo sapiens
  Payload ID: 16866
  Gene Symbol: SUCLA2
  Gene Name: succinate-CoA ligase, ADP-forming, beta subunit
  ENSP ID: ENSP00000415091
MAASMFYGRLVAVATLRNHRPRTAQRAAAQGPVLIGSSHGGVNIEDVAAESPEAIIKEPIDIEEGIKKEQALQLAQKMGFPPNIVESAAENMVKLYSLFLKYDATMIEINPMVEDSDGAVLCMDAKINFDSNSAYRQKKIFDLQDWTQEDERDK

SEQ ID NO: 84788 - protein, 191 aa, Homo sapiens
  Payload ID: 16866
  Gene Symbol: SUCLA2
  Gene Name: succinate-CoA ligase, ADP-forming, beta subunit
  ENSP ID: ENSP00000488974
MAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGEKGRICNQVLVCERKYPRREYYFAITMERSFQVSNCRHDTYGINL

SEQ ID NO: 84789 - protein, 80 aa, Homo sapiens
  Payload ID: 16866
  Gene Symbol: SUCLA2
  Gene Name: succinate-CoA ligase, ADP-forming, beta subunit
  ENSP ID: ENSP00000489055
CDVIAQGIVMAVKDLEIKIPVVVRLQGTRVDDAKALIADSGLKILACDDLDEAARMVVKLSEIVTLAKQAHVDVKFQLPI

SEQ ID NO: 84790 - protein, 136 aa, Homo sapiens
  Payload ID: 16866
  Gene Symbol: SUCLA2
  Gene Name: succinate-CoA ligase, ADP-forming, beta subunit
  ENSP ID: ENSP00000489175
AASMFYGRLVAVATLRNHRPRTAQRAAAQVLGSSGLFNNHGLQVQQQQQRNLSLHEYMSMELLQEAGVSVPKGYVAKSPDEAYAIAKKLGTEERNNMCRINCNYEYFWQVLWDQNSQVIRSRFKRCRDKGTGFSWW

SEQ ID NO: 84791 - protein, 104 aa, Homo sapiens
  Payload ID: 16866
  Gene Symbol: SUCLA2
  Gene Name: succinate-CoA ligase, ADP-forming, beta subunit
  ENSP ID: ENSP00000489542
  MOD_RES (1)..(1): Any amino acid
XFQGPVLIGSSHGGVNIEDVAAESPEAIIKEPIDIEEGIKKEQALQLAQKMGFPPNIVESAAENMVKLYSLFLKYDATMIEINPMVEDSDGADEDLPTLALLTF

SEQ ID NO: 84792 - protein, 346 aa, Homo sapiens
  Payload ID: 16867
  Gene Symbol: SUCLG1
  Gene Name: succinate-CoA ligase, alpha subunit
  Uniprot ID: P53597
  ENSP ID: ENSP00000377446
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 84793 - protein, 105 aa, Homo sapiens
  Payload ID: 16867
  Gene Symbol: SUCLG1
  Gene Name: succinate-CoA ligase, alpha subunit
  ENSP ID: ENSP00000403884
  MOD_RES (1)..(1): Any amino acid
XTLAAAADIATMVSGSSGLAAARLLSRSFLLPQNGIRHCSYTASRQHLYVDKNTKIICQGFTGKQELLLLTRHLSQPAGIGIWHQTRWRNHSRERRPDTSGLTCL

SEQ ID NO: 84794 - protein, 432 aa, Homo sapiens
  Payload ID: 16868
  Gene Symbol: SUCLG2
  Gene Name: succinate-CoA ligase, GDP-forming, beta subunit
  Uniprot ID: Q96I99
  ENSP ID: ENSP00000307432
MASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIANGITKACRELELKVPLVVRLEGTNVQEAQKILNNSGLPITSAIDLEDAAKKAVASVAKK

SEQ ID NO: 84795 - protein, 190 aa, Homo sapiens
  Payload ID: 16868
  Gene Symbol: SUCLG2
  Gene Name: succinate-CoA ligase, GDP-forming, beta subunit
  ENSP ID: ENSP00000417260
  MOD_RES (1)..(1): Any amino acid
XPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQVEAILVNIFGGIVNCAIIANGITKACRELELKVPLVVRLEGTNVQEAQKILNNSGLPITSAIDLEDAAKKAVASVAKK

SEQ ID NO: 84796 - protein, 379 aa, Homo sapiens
  Payload ID: 16868
  Gene Symbol: SUCLG2
  Gene Name: succinate-CoA ligase, GDP-forming, beta subunit
  ENSP ID: ENSP00000417589
MASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKQQNLKARNTWAPEYRTQKHVLEAWK

SEQ ID NO: 84797 - protein, 440 aa, Homo sapiens
  Payload ID: 16868
  Gene Symbol: SUCLG2
  Gene Name: succinate-CoA ligase, GDP-forming, beta subunit
  Uniprot ID: Q96I99
  ENSP ID: ENSP00000419325
MASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIANGITKACRELELKVPLVVRLEGTFMEKKGSYMHIKQETGNSNENITGIQENVAHQNLSKCAISIFLC

SEQ ID NO: 84798 - protein, 445 aa, Homo sapiens
  Payload ID: 16869
  Gene Symbol: SUGCT
  Gene Name: succinyl-CoA:glutarate-CoA transferase
  Uniprot ID: Q9HAC7
  ENSP ID: ENSP00000338475
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 84799 - protein, 397 aa, Homo sapiens
  Payload ID: 16869
  Gene Symbol: SUGCT
  Gene Name: succinyl-CoA:glutarate-CoA transferase
  Uniprot ID: Q9HAC7
  ENSP ID: ENSP00000385222
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPEVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 84800 - protein, 421 aa, Homo sapiens
  Payload ID: 16869
  Gene Symbol: SUGCT
  Gene Name: succinyl-CoA:glutarate-CoA transferase
  ENSP ID: ENSP00000393032
  MOD_RES (1)..(1): Any amino acid
XAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVSSLVLPLMSCRVSWRLVHGNGHFCSDVGTHHWRVWPTLHVRCASTAASSTGNCFG

SEQ ID NO: 84801 - protein, 180 aa, Homo sapiens
  Payload ID: 16869
  Gene Symbol: SUGCT
  Gene Name: succinyl-CoA:glutarate-CoA transferase
  ENSP ID: ENSP00000395000
  MOD_RES (1)..(1): Any amino acid
XRDAGDAGEGGSSAQNLPLLRPGRREGAVDWPPAVSKAMYFYRRMRPYRWNNDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSIT

SEQ ID NO: 84802 - protein, 49 aa, Homo sapiens
  Payload ID: 16869
  Gene Symbol: SUGCT
  Gene Name: succinyl-CoA:glutarate-CoA transferase
  ENSP ID: ENSP00000401187
  MOD_RES (1)..(1): Any amino acid
XPSETHAMLATLARVAALRRTCLFSGRGGGRGLWTGRPQSESWRDLLLL

SEQ ID NO: 84803 - protein, 471 aa, Homo sapiens
  Payload ID: 16869
  Gene Symbol: SUGCT
  Gene Name: succinyl-CoA:glutarate-CoA transferase
  Uniprot ID: Q9HAC7
  ENSP ID: ENSP00000486291
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQNAVSGFQSLLHSLAHGPFLHLQGSARVLHNGLVMEMEHPTVGKISVPGPAVRYSKFKMSEARPPPLLGQHTTHILKEVLRYDDRAIGELLSAGVVDQHETH

SEQ ID NO: 84804 - protein, 1827 aa, Homo sapiens
  Payload ID: 16870
  Gene Symbol: SI
  Gene Name: sucrase-isomaltase (alpha-glucosidase)
  Uniprot ID: P14410
  ENSP ID: ENSP00000264382
MARKKFSGLEISLIVLFVIVTIIAIALIVVLATKTPAVDEISDSTSTPATTRVTTNPSDSGKCPNVLNDPVNVRINCIPEQFPTEGICAQRGCCWRPWNDSLIPWCFFVDNHGYNVQDMTTTSIGVEAKLNRIPSPTLFGNDINSVLFTTQNQTPNRFRFKITDPNNRRYEVPHQYVKEFTGPTVSDTLYDVKVAQNPFSIQVIRKSNGKTLFDTSIGPLVYSDQYLQISTRLPSDYIYGIGEQVHKRFRHDLSWKTWPIFTRDQLPGDNNNNLYGHQTFFMCIEDTSGKSFGVFLMNSNAMEIFIQPTPIVTYRVTGGILDFYILLGDTPEQVVQQYQQLVGLPAMPAYWNLGFQLSRWNYKSLDVVKEVVRRNREAGIPFDTQVTDIDYMEDKKDFTYDQVAFNGLPQFVQDLHDHGQKYVIILDPAISIGRRANGTTYATYERGNTQHVWINESDGSTPIIGEVWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNHNSDGYEHQDPAFFGQNSLLVKSSRQYLTIRYTLLPFLYTLFYKAHVFGETVARPVLHEFYEDTNSWIEDTEFLWGPALLITPVLKQGADTVSAYIPDAIWYDYESGAKRPWRKQRVDMYLPADKIGLHLRGGYIIPIQEPDVTTTASRKNPLGLIVALGENNTAKGDFFWDDGETKDTIQNGNYILYTFSVSNNTLDIVCTHSSYQEGTTLAFQTVKILGLTDSVTEVRVAENNQPMNAHSNFTYDASNQVLLIADLKLNLGRNFSVQWNQIFSENERFNCYPDADLATEQKCTQRGCVWRTGSSLSKAPECYFPRQDNSYSVNSARYSSMGITADLQLNTANARIKLPSDPISTLRVEVKYHKNDMLQFKIYDPQKKRYEVPVPLNIPTTPISTYEDRLYDVEIKENPFGIQIRRRSSGRVIWDSWLPGFAFNDQFIQISTRLPSEYIYGFGEVEHTAFKRDLNWNTWGMFTRDQPPGYKLNSYGFHPYYMALEEEGNAHGVFLLNSNAMDVTFQPTPALTYRTVGGILDFYMFLGPTPEVATKQYHEVIGHPVMPAYWALGFQLCRYGYANTSEVRELYDAMVAANIPYDVQYTDIDYMERQLDFTIGEAFQDLPQFVDKIRGEGMRYIIILDPAISGNETKTYPAFERGQQNDVFVKWPNTNDICWAKVWPDLPNITIDKTLTEDEAVNASRAHVAFPDFFRTSTAEWWAREIVDFYNEKMKFDGLWIDMNEPSSFVNGTTTNQCRNDELNYPPYFPELTKRTDGLHFRTICMEAEQILSDGTSVLHYDVHNLYGWSQMKPTHDALQKTTGKRGIVISRSTYPTSGRWGGHWLGDNYARWDNMDKSIIGMMEFSLFGMSYTGADICGFFNNSEYHLCTRWMQLGAFYPYSRNHNIANTRRQDPASWNETFAEMSRNILNIRYTLLPYFYTQMHEIHANGGTVIRPLLHEFFDEKPTWDIFKQFLWGPAFMVTPVLEPYVQTVNAYVPNARWFDYHTGKDIGVRGQFQTFNASYDTINLHVRGGHILPCQEPAQNTFYSRQKHMKLIVAADDNQMAQGSLFWDDGESIDTYERDLYLSVQFNLNQTTLTSTILKRGYINKSETRLGSLHVWGKGTTPVNAVTLTYNGNKNSLPFNEDTTNMILRIDLTTHNVTLEEPIEINWS

SEQ ID NO: 84805 - protein, 46 aa, Homo sapiens
  Payload ID: 16870
  Gene Symbol: SI
  Gene Name: sucrase-isomaltase (alpha-glucosidase)
  ENSP ID: ENSP00000419450
MARKKFSGLEISLIVLFVIVTIIAIALIVVLATKTPAVDVFSSPRN

SEQ ID NO: 84806 - protein, 871 aa, Homo sapiens
  Payload ID: 16871
  Gene Symbol: SULF1
  Gene Name: sulfatase 1
  Uniprot ID: Q8IWU6
  ENSP ID: ENSP00000260128
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 84807 - protein, 871 aa, Homo sapiens; identical to SEQ ID NO: 84806
  Payload ID: 16871
  Gene Symbol: SULF1
  Gene Name: sulfatase 1
  Uniprot ID: Q8IWU6
  ENSP ID: ENSP00000385704

SEQ ID NO: 84808 - protein, 871 aa, Homo sapiens; identical to SEQ ID NO: 84806
  Payload ID: 16871
  Gene Symbol: SULF1
  Gene Name: sulfatase 1
  Uniprot ID: Q8IWU6
  ENSP ID: ENSP00000390315

SEQ ID NO: 84809 - protein, 871 aa, Homo sapiens; identical to SEQ ID NO: 84806
  Payload ID: 16871
  Gene Symbol: SULF1
  Gene Name: sulfatase 1
  Uniprot ID: Q8IWU6
  ENSP ID: ENSP00000403040

SEQ ID NO: 84810 - protein, 56 aa, Homo sapiens
  Payload ID: 16871
  Gene Symbol: SULF1
  Gene Name: sulfatase 1
  ENSP ID: ENSP00000431308
MKYSCCALVLAVLGTELLGSLCSTVRSPRFRGRIQQERKNIRPNIILVLTDDQDVE

SEQ ID NO: 84811 - protein, 172 aa, Homo sapiens
  Payload ID: 16871
  Gene Symbol: SULF1
  Gene Name: sulfatase 1
  ENSP ID: ENSP00000431753
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYT

SEQ ID NO: 84812 - protein, 84 aa, Homo sapiens
  Payload ID: 16871
  Gene Symbol: SULF1
  Gene Name: sulfatase 1
  ENSP ID: ENSP00000432178
MKYSCCALVLAVLGTELLGSLCSTVRSPRFRGRIQQERKNIRPNIILVLTDDQDVELGSLQVMNKTRKIMEHGGATFINAFVTT

SEQ ID NO: 84813 - protein, 131 aa, Homo sapiens
  Payload ID: 16871
  Gene Symbol: SULF1
  Gene Name: sulfatase 1
  ENSP ID: ENSP00000434128
  MOD_RES (1)..(1): Any amino acid
XREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNPHKYSAHGRTRHFESATRTTNGAQKLSRI

SEQ ID NO: 84814 - protein, 29 aa, Homo sapiens
  Payload ID: 16871
  Gene Symbol: SULF1
  Gene Name: sulfatase 1
  ENSP ID: ENSP00000436608
MKYSCCALVLAVLGTELLGSLCSTVRSPR

SEQ ID NO: 84815 - protein, 76 aa, Homo sapiens
  Payload ID: 16871
  Gene Symbol: SULF1
  Gene Name: sulfatase 1
  ENSP ID: ENSP00000436949
MKYSCCALVLAVLGTELLGSLCSTVRSPRFRGRIQQERKNIRPNIILVLTDDQDVELGSLQVMNKTRKIMEHGGAT

SEQ ID NO: 84816 - protein, 669 aa, Homo sapiens
  Payload ID: 16871
  Gene Symbol: SULF1
  Gene Name: sulfatase 1
  ENSP ID: ENSP00000480454
MVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRMLLFLVPCSAPLTSRAMVSDASF

SEQ ID NO: 84817 - protein, 870 aa, Homo sapiens
  Payload ID: 16872
  Gene Symbol: SULF2
  Gene Name: sulfatase 2
  Uniprot ID: Q8IWU5
  ENSP ID: ENSP00000353007
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 84818 - protein, 189 aa, Homo sapiens
  Payload ID: 16872
  Gene Symbol: SULF2
  Gene Name: sulfatase 2
  ENSP ID: ENSP00000410026
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSK

SEQ ID NO: 84819 - protein, 207 aa, Homo sapiens
  Payload ID: 16872
  Gene Symbol: SULF2
  Gene Name: sulfatase 2
  ENSP ID: ENSP00000417894
  MOD_RES (1)..(1): Any amino acid
XEVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRGQLWEGWEG

SEQ ID NO: 84820 - protein, 870 aa, Homo sapiens; identical to SEQ ID NO: 84817
  Payload ID: 16872
  Gene Symbol: SULF2
  Gene Name: sulfatase 2
  Uniprot ID: Q8IWU5
  ENSP ID: ENSP00000418290

SEQ ID NO: 84821 - protein, 867 aa, Homo sapiens
  Payload ID: 16872
  Gene Symbol: SULF2
  Gene Name: sulfatase 2
  Uniprot ID: Q8IWU5
  ENSP ID: ENSP00000418442
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLDGGSYEQYRQFQRRKWPEMKRPSSKSLGQLWEGWEG

SEQ ID NO: 84822 - protein, 374 aa, Homo sapiens
  Payload ID: 16873
  Gene Symbol: SUMF1
  Gene Name: sulfatase modifying factor 1
  Uniprot ID: Q8NBK3
  ENSP ID: ENSP00000272902
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 84823 - protein, 349 aa, Homo sapiens
  Payload ID: 16873
  Gene Symbol: SUMF1
  Gene Name: sulfatase modifying factor 1
  Uniprot ID: Q8NBK3
  ENSP ID: ENSP00000373355
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 84824 - protein, 354 aa, Homo sapiens
  Payload ID: 16873
  Gene Symbol: SUMF1
  Gene Name: sulfatase modifying factor 1
  Uniprot ID: Q8NBK3
  ENSP ID: ENSP00000384977
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPSYCYRYRCAARSQNTPDSSASNLGFRCAADRLPTMD

SEQ ID NO: 84825 - protein, 426 aa, Homo sapiens
  Payload ID: 16873
  Gene Symbol: SUMF1
  Gene Name: sulfatase modifying factor 1
  ENSP ID: ENSP00000404384
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSQEYYDPYFQDVASEMLRRHTASRWKAFSSLEPCCSIRRHQQYAAIERLTCGKFELRCASLRKIDCLNTNIACSYSMRQDGPRLHCVD

SEQ ID NO: 84826 - protein, 242 aa, Homo sapiens
  Payload ID: 16873
  Gene Symbol: SUMF1
  Gene Name: sulfatase modifying factor 1
  ENSP ID: ENSP00000410060
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 84827 - protein, 213 aa, Homo sapiens
  Payload ID: 16874
  Gene Symbol: SUMF2
  Gene Name: sulfatase modifying factor 2
  Uniprot ID: Q8NBJ7
  ENSP ID: ENSP00000275607
MFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 84828 - protein, 358 aa, Homo sapiens
  Payload ID: 16874
  Gene Symbol: SUMF2
  Gene Name: sulfatase modifying factor 2
  ENSP ID: ENSP00000341938
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGWATLQIQPQTTSVSAVLQTQAGRQGSCKQPGGDKEKSLLGSLSFPGHVANSAIPSSRASASGKNFPFPVSHPSVAGASHQGRRGLSLLCFGEGAQCVLTMAGGQVFLLEAKYY

SEQ ID NO: 84829 - protein, 236 aa, Homo sapiens
  Payload ID: 16874
  Gene Symbol: SUMF2
  Gene Name: sulfatase modifying factor 2
  ENSP ID: ENSP00000378823
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 84830 - protein, 305 aa, Homo sapiens
  Payload ID: 16874
  Gene Symbol: SUMF2
  Gene Name: sulfatase modifying factor 2
  ENSP ID: ENSP00000378824
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 84831 - protein, 150 aa, Homo sapiens
  Payload ID: 16874
  Gene Symbol: SUMF2
  Gene Name: sulfatase modifying factor 2
  ENSP ID: ENSP00000393423
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKVKFTHGGTGSSQTAPTCGRESSPRETKLRMASMESPQ

SEQ ID NO: 84832 - protein, 183 aa, Homo sapiens
  Payload ID: 16874
  Gene Symbol: SUMF2
  Gene Name: sulfatase modifying factor 2
  ENSP ID: ENSP00000395554
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVKFTHGGTGSSQTAPTCGRESSPRETKLRMASMESPQ

SEQ ID NO: 84833 - protein, 320 aa, Homo sapiens
  Payload ID: 16874
  Gene Symbol: SUMF2
  Gene Name: sulfatase modifying factor 2
  ENSP ID: ENSP00000400922
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 84834 - protein, 352 aa, Homo sapiens
  Payload ID: 16874
  Gene Symbol: SUMF2
  Gene Name: sulfatase modifying factor 2
  ENSP ID: ENSP00000406445
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRVLLCCPGWSAVAQSQLTTASNCQALAILPPQLLKYLGLQDGQHSRFSLRQPRFPLCCRRRPAARGAVSSRVVTRRKAF

SEQ ID NO: 84835 - protein, 165 aa, Homo sapiens
  Payload ID: 16874
  Gene Symbol: SUMF2
  Gene Name: sulfatase modifying factor 2
  ENSP ID: ENSP00000407832
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQVKFTHGGTGSSQTAPTCGRESSPRETKLRMASMESPQ

SEQ ID NO: 84836 - protein, 102 aa, Homo sapiens
  Payload ID: 16874
  Gene Symbol: SUMF2
  Gene Name: sulfatase modifying factor 2
  ENSP ID: ENSP00000407954
MARHGLPLLPLLSLLVGAWLKLGNGQATSMVQLQGGRFLMGTNSPDSRDGDGPVREATVKPFAIDIFPVTNKDFRSSLPMGELVPAKPHQPVAGKVPQGRQS

SEQ ID NO: 84837 - protein, 304 aa, Homo sapiens
  Payload ID: 16874
  Gene Symbol: SUMF2
  Gene Name: sulfatase modifying factor 2
  ENSP ID: ENSP00000410796
HGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSGRCLCWAGASCSRSPSFSQSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLG

SEQ ID NO: 84838 - protein, 293 aa, Homo sapiens
  Payload ID: 16874
  Gene Symbol: SUMF2
  Gene Name: sulfatase modifying factor 2
  ENSP ID: ENSP00000414434
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRYIRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARV

SEQ ID NO: 84839 - protein, 51 aa, Homo sapiens
  Payload ID: 16874
  Gene Symbol: SUMF2
  Gene Name: sulfatase modifying factor 2
  ENSP ID: ENSP00000415322
MARHGLPLLPLLSLLVGAWLKLGILSGRKSIGQKLRCLDGALSLRTLSLMS

SEQ ID NO: 84840 - protein, 232 aa, Homo sapiens
  Payload ID: 16874
  Gene Symbol: SUMF2
  Gene Name: sulfatase modifying factor 2
  ENSP ID: ENSP00000415989
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 84841 - protein, 450 aa, Homo sapiens
  Payload ID: 16875
  Gene Symbol: SQRDL
  Gene Name: sulfide quinone reductase-like (yeast)
  Uniprot ID: Q9Y6N5
  ENSP ID: ENSP00000260324
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLIEVRADKQEAVFENLDKPGETQVISYEMLHVTPPMSPPDVLKTSPVADAAGWVDVDKETLQHRRYPNVFGIGDCTNLPTSKTAAAVAAQSGILDRTISVIMKNQTPTKKYDGYTSCPLVTGYNRVILAEFDYKAEPLETFPFDQSKERLSMYLMKADLMPFLYWNMMLRGYWGGPAFLRKLFHLGMS

SEQ ID NO: 84842 - protein, 181 aa, Homo sapiens
  Payload ID: 16875
  Gene Symbol: SQRDL
  Gene Name: sulfide quinone reductase-like (yeast)
  ENSP ID: ENSP00000454520
  MOD_RES (1)..(1): Any amino acid
XGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKVCFLSGDRDEQGGQC

SEQ ID NO: 84843 - protein, 124 aa, Homo sapiens
  Payload ID: 16875
  Gene Symbol: SQRDL
  Gene Name: sulfide quinone reductase-like (yeast)
  ENSP ID: ENSP00000454953
  MOD_RES (1)..(1): Any amino acid
XADAAGWVDVDKETLQHRRYPNVFGIGDCTNLPTSKTAAAVAAQSGILDRTISVIMKNQTPTKKYDGYTSCPLVTGYNRVILAEFDYKAEPLETFPFDQSKERLSMYLMKADLMPFLYWNMMLR

SEQ ID NO: 84844 - protein, 450 aa, Homo sapiens; identical to SEQ ID NO: 84841
  Payload ID: 16875
  Gene Symbol: SQRDL
  Gene Name: sulfide quinone reductase-like (yeast)
  Uniprot ID: Q9Y6N5
  ENSP ID: ENSP00000456019

SEQ ID NO: 84845 - protein, 140 aa, Homo sapiens
  Payload ID: 16875
  Gene Symbol: SQRDL
  Gene Name: sulfide quinone reductase-like (yeast)
  ENSP ID: ENSP00000456075
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRY

SEQ ID NO: 84846 - protein, 38 aa, Homo sapiens
  Payload ID: 16875
  Gene Symbol: SQRDL
  Gene Name: sulfide quinone reductase-like (yeast)
  ENSP ID: ENSP00000456979
MVPLVAVVSGPRAQLFACLLRLGTQQVGPLQLHTGASH

SEQ ID NO: 84847 - protein, 73 aa, Homo sapiens
  Payload ID: 16875
  Gene Symbol: SQRDL
  Gene Name: sulfide quinone reductase-like (yeast)
  ENSP ID: ENSP00000457592
MVPLVAVVSGPRAQLFACLLRLGTQQVGPLQLHTGASHAARNHYEVLVLGGGSGGITMAARMKRKVGAENVAI

SEQ ID NO: 84848 - protein, 141 aa, Homo sapiens
  Payload ID: 16875
  Gene Symbol: SQRDL
  Gene Name: sulfide quinone reductase-like (yeast)
  ENSP ID: ENSP00000457937
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYL

SEQ ID NO: 84849 - protein, 137 aa, Homo sapiens
  Payload ID: 16876
  Gene Symbol: SRXN1
  Gene Name: sulfiredoxin 1
  Uniprot ID: Q9BYN0
  ENSP ID: ENSP00000371388
MGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 84850 - protein, 545 aa, Homo sapiens
  Payload ID: 16877
  Gene Symbol: SUOX
  Gene Name: sulfite oxidase
  Uniprot ID: P51687
  ENSP ID: ENSP00000266971
MLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGGPSKLMLAAGGPLEPFWALYAVHNQSHVRELLAQYKIGELNPEDKVAPTVETSDPYADDPVRHPALKVNSQRPFNAEPPPELLTENYITPNPIFFTRNHLPVPNLDPDTYRLHVVGAPGGQSLSLSLDDLHNFPRYEITVTLQCAGNRRSEMTQVKEVKGLEWRTGAISTARWAGARLCDVLAQAGHQLCETEAHVCFEGLDSDPTGTAYGASIPLARAMDPEAEVLLAYEMNGQPLPRDHGFPVRVVVPGVVGARHVKWLGRVSVQPEESYSHWQRRDYKGFSPSVDWETVDFDSAPSIQELPVQSAITEPRDGETVESGEVTIKGYAWSGGGRAVIRVDVSLDGGLTWQVAKLDGEEQRPRKAWAWRLWQLKAPVPAGQKELNIVCKAVDDGYNVQPDTVAPIWNLRGVLSNAWHRVHVYVSP

SEQ ID NO: 84851 - protein, 545 aa, Homo sapiens; identical to SEQ ID NO: 84850
  Payload ID: 16877
  Gene Symbol: SUOX
  Gene Name: sulfite oxidase
  Uniprot ID: P51687
  ENSP ID: ENSP00000348440

SEQ ID NO: 84852 - protein, 545 aa, Homo sapiens; identical to SEQ ID NO: 84850
  Payload ID: 16877
  Gene Symbol: SUOX
  Gene Name: sulfite oxidase
  Uniprot ID: P51687
  ENSP ID: ENSP00000377668

SEQ ID NO: 84853 - protein, 545 aa, Homo sapiens; identical to SEQ ID NO: 84850
  Payload ID: 16877
  Gene Symbol: SUOX
  Gene Name: sulfite oxidase
  Uniprot ID: P51687
  ENSP ID: ENSP00000377674

SEQ ID NO: 84854 - protein, 42 aa, Homo sapiens
  Payload ID: 16877
  Gene Symbol: SUOX
  Gene Name: sulfite oxidase
  ENSP ID: ENSP00000448637
MLLLHRAVVLRLQQACRLKSIPSRICIQACSTNDSFQPQRPS

SEQ ID NO: 84855 - protein, 104 aa, Homo sapiens
  Payload ID: 16877
  Gene Symbol: SUOX
  Gene Name: sulfite oxidase
  ENSP ID: ENSP00000449443
MLLLHRAVVLRLQQACRLKSIPSRICIQACSTNDSFQPQRPSLTFSGDNSSTQGWRVMGTLLGLGAVLAYQDHRCRAAQESTHIYTKEEVRDHSHSAVCRQPTL

SEQ ID NO: 84856 - protein, 161 aa, Homo sapiens
  Payload ID: 16877
  Gene Symbol: SUOX
  Gene Name: sulfite oxidase
  ENSP ID: ENSP00000449872
MLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGGPSKLMLAAGGPLEPFWALYAVHNQSHVRELLAQYKIGELN

SEQ ID NO: 84857 - protein, 121 aa, Homo sapiens
  Payload ID: 16877
  Gene Symbol: SUOX
  Gene Name: sulfite oxidase
  ENSP ID: ENSP00000450049
MLLLHRAVVLRLQQACRLKSIPSRICIQACSTNDSFQPQRPSLTFSGDNSSTQGWRVMGTLLGLGAVLAYQDHRCRAAQESTHIYTKEEVSSHTSPETGIWVTLGSEVFDVTEFVDLHPGG

SEQ ID NO: 84858 - protein, 545 aa, Homo sapiens; identical to SEQ ID NO: 84850
  Payload ID: 16877
  Gene Symbol: SUOX
  Gene Name: sulfite oxidase
  Uniprot ID: P51687
  ENSP ID: ENSP00000450245

SEQ ID NO: 84859 - protein, 545 aa, Homo sapiens; identical to SEQ ID NO: 84850
  Payload ID: 16877
  Gene Symbol: SUOX
  Gene Name: sulfite oxidase
  Uniprot ID: P51687
  ENSP ID: ENSP00000450264

SEQ ID NO: 84860 - protein, 294 aa, Homo sapiens
  Payload ID: 16878
  Gene Symbol: SULT1E1
  Gene Name: sulfotransferase family 1E, estrogen-preferring, member 1
  Uniprot ID: P49888
  ENSP ID: ENSP00000226444
MNSELDYYEKFEEVHGILMYKDFVKYWDNVEAFQARPDDLVIATYPKSGTTWVSEIVYMIYKEGDVEKCKEDVIFNRIPFLECRKENLMNGVKQLDEMNSPRIVKTHLPPELLPASFWEKDCKIIYLCRNAKDVAVSFYYFFLMVAGHPNPGSFPEFVEKFMQGQVPYGSWYKHVKSWWEKGKSPRVLFLFYEDLKEDIRKEVIKLIHFLERKPSEELVDRIIHHTSFQEMKNNPSTNYTTLPDEIMNQKLSPFMRKGITGDWKNHFTVALNEKFDKHYEQQMKESTLKFRTEI

SEQ ID NO: 84861 - protein, 127 aa, Homo sapiens
  Payload ID: 16878
  Gene Symbol: SULT1E1
  Gene Name: sulfotransferase family 1E, estrogen-preferring, member 1
  ENSP ID: ENSP00000420891
  MOD_RES (1)..(1): Any amino acid
XGSWYKHVKSWWEKGKSPRVLFLFYEDLKEDIRKEVIKLIHFLERKPSEELVDRIIHHTSFQEMKNNPSTNYTTLPDEIMNQKLSPFMRKGITGDWKNHFTVALNEKFDKHYEQQMKESTLKFRTEI

SEQ ID NO: 84862 - protein, 284 aa, Homo sapiens
  Payload ID: 16879
  Gene Symbol: SULT4A1
  Gene Name: sulfotransferase family 4A, member 1
  Uniprot ID: Q9BR01
  ENSP ID: ENSP00000332565
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 84863 - protein, 260 aa, Homo sapiens
  Payload ID: 16879
  Gene Symbol: SULT4A1
  Gene Name: sulfotransferase family 4A, member 1
  Uniprot ID: Q9BR01
  ENSP ID: ENSP00000388285
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRAHCVFARKIFLSW

SEQ ID NO: 84864 - protein, 75 aa, Homo sapiens
  Payload ID: 16879
  Gene Symbol: SULT4A1
  Gene Name: sulfotransferase family 4A, member 1
  ENSP ID: ENSP00000414220
MAESEAETPSTPGEFESKYFEFHGVRLPPFCRGKMEEIANFPVRPSDVWIVTYPKSGTDLSPPHQEPPALPLSAL

SEQ ID NO: 84865 - protein, 295 aa, Homo sapiens
  Payload ID: 16880
  Gene Symbol: SULT1A1
  Gene Name: sulfotransferase family, cytosolic, 1A, phenol-preferring, member 1
  Uniprot ID: P50225
  ENSP ID: ENSP00000321988
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPFMRKGMAGDWKTTFTVAQNERFDADYAEKMAGCSLSFRSEL

SEQ ID NO: 84866 - protein, 217 aa, Homo sapiens
  Payload ID: 16880
  Gene Symbol: SULT1A1
  Gene Name: sulfotransferase family, cytosolic, 1A, phenol-preferring, member 1
  Uniprot ID: P50225
  ENSP ID: ENSP00000329399
MLAKLLCDQVVGAPIAVSAFYAGMSILQGKDDIFLDLKQKFWNTYMVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPFMRKGMAGDWKTTFTVAQNERFDADYAEKMAGCSLSFRSEL

SEQ ID NO: 84867 - protein, 295 aa, Homo sapiens; identical to SEQ ID NO: 84865
  Payload ID: 16880
  Gene Symbol: SULT1A1
  Gene Name: sulfotransferase family, cytosolic, 1A, phenol-preferring, member 1
  Uniprot ID: P50225
  ENSP ID: ENSP00000378971

SEQ ID NO: 84868 - protein, 295 aa, Homo sapiens; identical to SEQ ID NO: 84865
  Payload ID: 16880
  Gene Symbol: SULT1A1
  Gene Name: sulfotransferase family, cytosolic, 1A, phenol-preferring, member 1
  Uniprot ID: P50225
  ENSP ID: ENSP00000378972

SEQ ID NO: 84869 - protein, 56 aa, Homo sapiens
  Payload ID: 16880
  Gene Symbol: SULT1A1
  Gene Name: sulfotransferase family, cytosolic, 1A, phenol-preferring, member 1
  ENSP ID: ENSP00000454388
MLAKLLCDQVVGAPIAVSAFYAGMSILQGKDDIFLDLKQKFWNTYMQTQSWLWRSL

SEQ ID NO: 84870 - protein, 169 aa, Homo sapiens
  Payload ID: 16880
  Gene Symbol: SULT1A1
  Gene Name: sulfotransferase family, cytosolic, 1A, phenol-preferring, member 1
  ENSP ID: ENSP00000455979
MELIQDTSRPPLEYVKGVPLIKYFAEALGPLQSFQARPDDLLISTYPKSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFV

SEQ ID NO: 84871 - protein, 56 aa, Homo sapiens; identical to SEQ ID NO: 84869
  Payload ID: 16880
  Gene Symbol: SULT1A1
  Gene Name: sulfotransferase family, cytosolic, 1A, phenol-preferring, member 1
  ENSP ID: ENSP00000456215

SEQ ID NO: 84872 - protein, 281 aa, Homo sapiens
  Payload ID: 16880
  Gene Symbol: SULT1A1
  Gene Name: sulfotransferase family, cytosolic, 1A, phenol-preferring, member 1
  ENSP ID: ENSP00000456459
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPFMRKGMAGDWKTTFTVAQNERFDADYA

SEQ ID NO: 84873 - protein, 85 aa, Homo sapiens
  Payload ID: 16880
  Gene Symbol: SULT1A1
  Gene Name: sulfotransferase family, cytosolic, 1A, phenol-preferring, member 1
  ENSP ID: ENSP00000457083
MLAKLLCDQVVGAPIAVSAFYAGMSILQGKDDIFLDLKQKFWNTYMEHGADPGHLPPATGVREGGPAHQVLCRGTGAPAELPGPA

SEQ ID NO: 84874 - protein, 295 aa, Homo sapiens; identical to SEQ ID NO: 84865
  Payload ID: 16880
  Gene Symbol: SULT1A1
  Gene Name: sulfotransferase family, cytosolic, 1A, phenol-preferring, member 1
  Uniprot ID: P50225
  ENSP ID: ENSP00000457912

SEQ ID NO: 84875 - protein, 295 aa, Homo sapiens
  Payload ID: 16881
  Gene Symbol: SULT1A2
  Gene Name: sulfotransferase family, cytosolic, 1A, phenol-preferring, member 2
  Uniprot ID: P50226
  ENSP ID: ENSP00000338742
MELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLFYEDMKENPKREIQKILEFVGRSLPEETVDLMVEHTSFKEMKKNPMTNYTTVRREFMDHSISPFMRKGMAGDWKTTFTVAQNERFDADYAKKMAGCSLSFRSEL

SEQ ID NO: 84876 - protein, 295 aa, Homo sapiens; identical to SEQ ID NO: 84875
  Payload ID: 16881
  Gene Symbol: SULT1A2
  Gene Name: sulfotransferase family, cytosolic, 1A, phenol-preferring, member 2
  Uniprot ID: P50226
  ENSP ID: ENSP00000378992

SEQ ID NO: 84877 - protein, 221 aa, Homo sapiens
  Payload ID: 16881
  Gene Symbol: SULT1A2
  Gene Name: sulfotransferase family, cytosolic, 1A, phenol-preferring, member 2
  ENSP ID: ENSP00000433075
MELIQDISRPPLEYVKGVPLIKYFAEALGPLQSFQARPDDLLISTYPKSGTTWVSQILDMIYQGGDLEKCHRAPIFMRVPFLEFKVPGIPSGVCVLGARGVEEDRAGASAHQTFPDPLLRDGDSEKHTSPTTPEDTPAPGSAPPDSVGSEGQGGLCCPQRKGCGGFLLPLLPHGQSVPSPWDLGKLPGEVHGWRSVLWVLVPARARVVGAEPHPPCSLPLL

SEQ ID NO: 84878 - protein, 262 aa, Homo sapiens
  Payload ID: 16881
  Gene Symbol: SULT1A2
  Gene Name: sulfotransferase family, cytosolic, 1A, phenol-preferring, member 2
  ENSP ID: ENSP00000435271
MELIQDISRPPLEYVKGVPLIKYFAEALGPLQSFQARPDDLLISTYPKSGTTWVSQILDMIYQGGDLEKCHRAPIFMRVPFLEFKVPGIPSGVCVLGARGVEEDRAGASAHQTFPDPLLRDGDSEKHTSPTTPEDTPAPGSAPPDSVGSEGQAIQASTEEPSAAQNPKREIQKILEFVGRSLPEETVDLMVEHTSFKEMKKNPMTNYTTVRREFMDHSISPFMRKGMAGDWKTTFTVAQNERFDADYAKKMAGCSLSFRSEL

SEQ ID NO: 84879 - protein, 192 aa, Homo sapiens
  Payload ID: 16881
  Gene Symbol: SULT1A2
  Gene Name: sulfotransferase family, cytosolic, 1A, phenol-preferring, member 2
  ENSP ID: ENSP00000435358
MELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLF

SEQ ID NO: 84880 - protein, 295 aa, Homo sapiens
  Payload ID: 16882
  Gene Symbol: SULT1A3
  Gene Name: sulfotransferase family, cytosolic, 1A, phenol-preferring, member 3
  Uniprot ID: P0DMM9
  ENSP ID: ENSP00000343645
MELIQDTSRPPLEYVKGVPLIKYFAEALGPLQSFQARPDDLLINTYPKSGTTWVSQILDMIYQGGDLEKCNRAPIYVRVPFLEVNDPGEPSGLETLKDTPPPRLIKSHLPLALLPQTLLDQKVKVVYVARNPKDVAVSYYHFHRMEKAHPEPGTWDSFLEKFMAGEVSYGSWYQHVQEWWELSRTHPVLYLFYEDMKENPKREIQKILEFVGRSLPEETMDFMVQHTSFKEMKKNPMTNYTTVPQELMDHSISPFMRKGMAGDWKTTFTVAQNERFDADYAEKMAGCSLSFRSEL

SEQ ID NO: 84881 - protein, 295 aa, Homo sapiens; identical to SEQ ID NO: 84880
  Payload ID: 16882
  Gene Symbol: SULT1A3
  Gene Name: sulfotransferase family, cytosolic, 1A, phenol-preferring, member 3
  Uniprot ID: P0DMM9
  ENSP ID: ENSP00000378570

SEQ ID NO: 84882 - protein, 301 aa, Homo sapiens
  Payload ID: 16882
  Gene Symbol: SULT1A3
  Gene Name: sulfotransferase family, cytosolic, 1A, phenol-preferring, member 3
  Uniprot ID: P0DMM9
  ENSP ID: ENSP00000454518
MELIQDTSRPPLEYVKGVPLIKYFAEALGPLQSFQARPDDLLINTYPKSGTTWVSQILDMIYQGGDLEKCNRAPIYVRVPFLEVNDPGEPSGLETLKDTPPPRLIKSHLPLALLPQTLLDQKVKVVYVARNPKDVAVSYYHFHRMEKAHPEPGTWDSFLEKFMAGEVSYGSWYQHVQEWWELSRTHPVLYLFYEDMKEEPSAAQNPKREIQKILEFVGRSLPEETMDFMVQHTSFKEMKKNPMTNYTTVPQELMDHSISPFMRKGMAGDWKTTFTVAQNERFDADYAEKMAGCSLSFRSEL

SEQ ID NO: 84883 - protein, 135 aa, Homo sapiens
  Payload ID: 16882
  Gene Symbol: SULT1A3
  Gene Name: sulfotransferase family, cytosolic, 1A, phenol-preferring, member 3
  ENSP ID: ENSP00000455372
  MOD_RES (1)..(1): Any amino acid
XYVRVPFLEVNDPGEPSGLETLKDTPPPRLIKSHLPLALLPQTLLDQKVKVVYVARNPKDVAVSYYHFHRMEKAHPEPGTWDSFLEKFMAGEVSYGSWYQHVQEWWELSRTHPVLYLFYEDMKEELMDHSISPFM

SEQ ID NO: 84884 - protein, 50 aa, Homo sapiens
  Payload ID: 16882
  Gene Symbol: SULT1A3
  Gene Name: sulfotransferase family, cytosolic, 1A, phenol-preferring, member 3
  ENSP ID: ENSP00000456391
  MOD_RES (1)..(1): Any amino acid
XPFLEVNDPGEPSGLETLKDTPPPRLIKSHLPLALLPQTLLDQKVKSAIV

SEQ ID NO: 84885 - protein, 295 aa, Homo sapiens; identical to SEQ ID NO: 84880
  Payload ID: 16883
  Gene Symbol: SULT1A4
  Gene Name: sulfotransferase family, cytosolic, 1A, phenol-preferring, member 4
  Uniprot ID: P0DMN0
  ENSP ID: ENSP00000353600

SEQ ID NO: 84886 - protein, 87 aa, Homo sapiens
  Payload ID: 16883
  Gene Symbol: SULT1A4
  Gene Name: sulfotransferase family, cytosolic, 1A, phenol-preferring, member 4
  ENSP ID: ENSP00000455063
MELIQDTSRPPLEYVKGVPLIKYFAEALGPLQSFQARPDDLLINTYPKSGTTWVSQILDMIYQGGDLEKCNRAPIYVRVPFLEGWRL

SEQ ID NO: 84887 - protein, 301 aa, Homo sapiens; identical to SEQ ID NO: 84882
  Payload ID: 16883
  Gene Symbol: SULT1A4
  Gene Name: sulfotransferase family, cytosolic, 1A, phenol-preferring, member 4
  ENSP ID: ENSP00000456834

SEQ ID NO: 84888 - protein, 50 aa, Homo sapiens; identical to SEQ ID NO: 84884
  Payload ID: 16883
  Gene Symbol: SULT1A4
  Gene Name: sulfotransferase family, cytosolic, 1A, phenol-preferring, member 4
  ENSP ID: ENSP00000457597
  MOD_RES (1)..(1): Any amino acid

SEQ ID NO: 84889 - protein, 296 aa, Homo sapiens
  Payload ID: 16884
  Gene Symbol: SULT1B1
  Gene Name: sulfotransferase family, cytosolic, 1B, member 1
  Uniprot ID: O43704
  ENSP ID: ENSP00000308770
MLSPKDILRKDLKLVHGYPMTCAFASNWEKIEQFHSRPDDIVIATYPKSGTTWVSEIIDMILNDGDIEKCKRGFITEKVPMLEMTLPGLRTSGIEQLEKNPSPRIVKTHLPTDLLPKSFWENNCKMIYLARNAKDVSVSYYHFDLMNNLQPFPGTWEEYLEKFLTGKVAYGSWFTHVKNWWKKKEEHPILFLYYEDMKENPKEEIKKIIRFLEKNLNDEILDRIIHHTSFEVMKDNPLVNYTHLPTTVMDHSKSPFMRKGTAGDWKNYFTVAQNEKFDAIYETEMSKTALQFRTEI

SEQ ID NO: 84890 - protein, 155 aa, Homo sapiens
  Payload ID: 16884
  Gene Symbol: SULT1B1
  Gene Name: sulfotransferase family, cytosolic, 1B, member 1
  ENSP ID: ENSP00000425464
MLSPKDILRKDLKLVHGYPMTCAFASNWEKIEQFHSRPDDIVIATYPKSGTTWVSEIIDMILNDGDIEKCKRGFITEKVPMLEMTLPGLRTSGIEQLEKNPSPRIVKTHLPTDLLPKSFWENNCKMIYLARNAKDVSVSYYHFDLMNNLQPFPGT

SEQ ID NO: 84891 - protein, 73 aa, Homo sapiens
  Payload ID: 16884
  Gene Symbol: SULT1B1
  Gene Name: sulfotransferase family, cytosolic, 1B, member 1
  ENSP ID: ENSP00000427536
MTCAFASNWEKIEQFHSRPDDIVIATYPKSGTTWVSEIIDMILNDGDIEKCKRGFITEKVPMLEMTLPGLRTS

SEQ ID NO: 84892 - protein, 296 aa, Homo sapiens
  Payload ID: 16885
  Gene Symbol: SULT1C2
  Gene Name: sulfotransferase family, cytosolic, 1C, member 2
  Uniprot ID: O00338
  ENSP ID: ENSP00000251481
MALTSDLGKQIKLKEVEGTLLQPATVDNWSQIQSFEAKPDDLLICTYPKAGTTWIQEIVDMIEQNGDVEKCQRAIIQHRHPFIEWARPPQPSGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 84893 - protein, 307 aa, Homo sapiens
  Payload ID: 16885
  Gene Symbol: SULT1C2
  Gene Name: sulfotransferase family, cytosolic, 1C, member 2
  Uniprot ID: O00338
  ENSP ID: ENSP00000319622
MALTSDLGKQIKLKEVEGTLLQPATVDNWSQIQSFEAKPDDLLICTYPKAGTTWIQEIVDMIEQNGDVEKCQRAIIQHRHPFIEWARPPQPSETGFHHVAQAGLKLLSSSNPPASTSQSAKITDLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 84894 - protein, 259 aa, Homo sapiens
  Payload ID: 16885
  Gene Symbol: SULT1C2
  Gene Name: sulfotransferase family, cytosolic, 1C, member 2
  ENSP ID: ENSP00000387054
MALTSDLGKQIKLKEVEGTLLQPATVDNWSQIQSFEAKPDDLLICTYPKAGTTWIQEIVDMIEQNGDVEKCQRAIIQHRHPFIEWARPPQPSARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 84895 - protein, 226 aa, Homo sapiens
  Payload ID: 16885
  Gene Symbol: SULT1C2
  Gene Name: sulfotransferase family, cytosolic, 1C, member 2
  ENSP ID: ENSP00000387340
  MOD_RES (1)..(1): Any amino acid
XSDLGKQIKLKEVEGTLLQPATVDNWSQIQSFEAKPDDLLICTYPKAGTTWIQEIVDMIEQNGDVEKCQRAIIQHRHPFIEWARPPQPSGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRELWGIGKTTSLLPRMRGLMKSIEERWKEPP

SEQ ID NO: 84896 - protein, 310 aa, Homo sapiens
  Payload ID: 16885
  Gene Symbol: SULT1C2
  Gene Name: sulfotransferase family, cytosolic, 1C, member 2
  ENSP ID: ENSP00000399651
MALTSDLGKQIKLKEVEGTLLQPATVDNWSQIQSFEAKPDDLLICTYPKAGTTWIQEIVDMIEQNGDVEKCQRAIIQHRHPFIEWARPPQPSVLVLRRCFLLSYFKGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 84897 - protein, 130 aa, Homo sapiens
  Payload ID: 16885
  Gene Symbol: SULT1C2
  Gene Name: sulfotransferase family, cytosolic, 1C, member 2
  ENSP ID: ENSP00000401996
MALTSDLGKQIKLKEVEGTLLQPATVDNWSQIQSFEAKPDDLLICTYPKAGTTWIQEIVDMIEQNGDVEKCQRAIIQHRHPFIEWARPPQPSAAATVFLGKQLQVPLCSSKCQRLYGFLLPFPKDEPHAS

SEQ ID NO: 84898 - protein, 116 aa, Homo sapiens
  Payload ID: 16885
  Gene Symbol: SULT1C2
  Gene Name: sulfotransferase family, cytosolic, 1C, member 2
  ENSP ID: ENSP00000415194
  MOD_RES (1)..(1): Any amino acid
XTSDLGKQIKLKEVEGTLLQPATVDNWSQIQSFEAKPDDLLICTYPKAGTTWIQEIVDMIEQNGDVEKCQRAIIQHRHPFIEWARPPQPSVPLCSSKCQRLYGFLLPFPKDEPHAS

SEQ ID NO: 84899 - protein, 304 aa, Homo sapiens
  Payload ID: 16886
  Gene Symbol: SULT1C3
  Gene Name: sulfotransferase family, cytosolic, 1C, member 3
  Uniprot ID: Q6IMI6
  ENSP ID: ENSP00000333310
MAKIEKNAPTMEKKPELFNIMEVDGVPTLILSKEWWEKVCNFQAKPDDLILATYPKSGTTWMHEILDMILNDGDVEKCKRAQTLDRHAFLELKFPHKEKPDLEFVLEMSSPQLIKTHLPSHLIPPSIWKENCKIVYVARNPKDCLVSYYHFHRMASFMPDPQNLEEFYEKFMSGKVVGGSWFDHVKGWWAAKDMHRILYLFYEDIKKDPKREIEKILKFLEKDISEEILNKIIYHTSFDVMKQNPMTNYTTLPTSIMDHSISPFMRKGMPGDWKNYFTVAQNEEFDKDYQKKMAGSTLTFRTEI

SEQ ID NO: 84900 - protein, 302 aa, Homo sapiens
  Payload ID: 16887
  Gene Symbol: SULT1C4
  Gene Name: sulfotransferase family, cytosolic, 1C, member 4
  Uniprot ID: O75897
  ENSP ID: ENSP00000272452
MALHDMEDFTFDGTKRLSVNYVKGILQPTDTCDIWDKIWNFQAKPDDLLISTYPKAGTTWTQEIVELIQNEGDVEKSKRAPTHQRFPFLEMKIPSLGSGLEQAHAMPSPRILKTHLPFHLLPPSLLEKNCKIIYVARNPKDNMVSYYHFQRMNKALPAPGTWEEYFETFLAGKVCWGSWHEHVKGWWEAKDKHRILYLFYEDMKKNPKHEIQKLAEFIGKKLDDKVLDKIVHYTSFDVMKQNPMANYSSIPAEIMDHSISPFMRKGAVGDWKKHFTVAQNERFDEDYKKKMTDTRLTFHFQF

SEQ ID NO: 84901 - protein, 227 aa, Homo sapiens
  Payload ID: 16887
  Gene Symbol: SULT1C4
  Gene Name: sulfotransferase family, cytosolic, 1C, member 4
  Uniprot ID: O75897
  ENSP ID: ENSP00000387225
MALHDMEDFTFDGTKRLSVNYVKGILQPTDTCDIWDKIWNFQAKPDDLLISTYPKAGTTWTQEIVELIQNEGDVEKSKRAPTHQRFPFLEMKIPSLGSVCWGSWHEHVKGWWEAKDKHRILYLFYEDMKKNPKHEIQKLAEFIGKKLDDKVLDKIVHYTSFDVMKQNPMANYSSIPAEIMDHSISPFMRKGAVGDWKKHFTVAQNERFDEDYKKKMTDTRLTFHFQF

SEQ ID NO: 84902 - protein, 285 aa, Homo sapiens
  Payload ID: 16888
  Gene Symbol: SULT2A1
  Gene Name: sulfotransferase family, cytosolic, 2A, dehydroepiandrosterone (DHEA)-preferring, member 1
  Uniprot ID: Q06520
  ENSP ID: ENSP00000222002
MSDDFLWFEGIAFPTMGFRSETLRKVRDEFVIRDEDVIILTYPKSGTNWLAEILCLMHSKGDAKWIQSVPIWERSPWVESEIGYTALSETESPRLFSSHLPIQLFPKSFFSSKAKVIYLMRNPRDVLVSGYFFWKNMKFIKKPKSWEEYFEWFCQGTVLYGSWFDHIHGWMPMREEKNFLLLSYEELKQDTGRTIEKICQFLGKTLEPEELNLILKNSSFQSMKENKMSNYSLLSVDYVVDKAQLLRKGVSGDWKNHFTVAQAEDFDKLFQEKMADLPRELFPWE

SEQ ID NO: 84903 - protein, 365 aa, Homo sapiens
  Payload ID: 16889
  Gene Symbol: SULT2B1
  Gene Name: sulfotransferase family, cytosolic, 2B, member 1
  Uniprot ID: O00204
  ENSP ID: ENSP00000201586
MDGPAEPQIPGLWDTYEDDISEISQKLPGEYFRYKGVPFPVGLYSLESISLAENTQDVRDDDIFIITYPKSGTTWMIEIICLILKEGDPSWIRSVPIWERAPWCETIVGAFSLPDQYSPRLMSSHLPIQIFTKAFFSSKAKVIYMGRNPRDVVVSLYHYSKIAGQLKDPGTPDQFLRDFLKGEVQFGSWFDHIKGWLRMKGKDNFLFITYEELQQDLQGSVERICGFLGRPLGKEALGSVVAHSTFSAMKANTMSNYTLLPPSLLDHRRGAFLRKGVCGDWKNHFTVAQSEAFDRAYRKQMRGMPTFPWDEDPEEDGSPDPEPSPEPEPKPSLEPNTSLEREPRPNSSPSPSPGQASETPHPRPS

SEQ ID NO: 84904 - protein, 350 aa, Homo sapiens
  Payload ID: 16889
  Gene Symbol: SULT2B1
  Gene Name: sulfotransferase family, cytosolic, 2B, member 1
  Uniprot ID: O00204
  ENSP ID: ENSP00000312880
MASPPPFHSQKLPGEYFRYKGVPFPVGLYSLESISLAENTQDVRDDDIFIITYPKSGTTWMIEIICLILKEGDPSWIRSVPIWERAPWCETIVGAFSLPDQYSPRLMSSHLPIQIFTKAFFSSKAKVIYMGRNPRDVVVSLYHYSKIAGQLKDPGTPDQFLRDFLKGEVQFGSWFDHIKGWLRMKGKDNFLFITYEELQQDLQGSVERICGFLGRPLGKEALGSVVAHSTFSAMKANTMSNYTLLPPSLLDHRRGAFLRKGVCGDWKNHFTVAQSEAFDRAYRKQMRGMPTFPWDEDPEEDGSPDPEPSPEPEPKPSLEPNTSLEREPRPNSSPSPSPGQASETPHPRPS

SEQ ID NO: 84905 - protein, 265 aa, Homo sapiens
  Payload ID: 16890
  Gene Symbol: SULT6B1
  Gene Name: sulfotransferase family, cytosolic, 6B, member 1
  ENSP ID: ENSP00000384950
MCTSETFQALDTFEARHDDIVLASYPKCGSNWILHIVSELIYAVSKKKYKYPEFPVLECGDSEKYQRMKGFPSPRILATHLHYDKLPGSIFENKAKILVIFRNPKDTAVSFLHFHNDVPDIPSYGSWDEFFRQFMKGQVSWGRYFDFAINWNKHLDGDNVKFILYEDLKENLAAGIKQIAEFLGFFLTGEQIQTISVQSTFQAMRAKSQDTHGAVGPFLFRKGEVGDWKNLFSEIQNQEMDEKFKECLAGTSLGAKLKYESYCQG

SEQ ID NO: 84906 - protein, 16 aa, Homo sapiens
  Payload ID: 16890
  Gene Symbol: SULT6B1
  Gene Name: sulfotransferase family, cytosolic, 6B, member 1
  ENSP ID: ENSP00000395999
MCTSETFQALDTFEAR

SEQ ID NO: 84907 - protein, 16 aa, Homo sapiens
  Payload ID: 16890
  Gene Symbol: SULT6B1
  Gene Name: sulfotransferase family, cytosolic, 6B, member 1
  ENSP ID: ENSP00000407014
MCTSETFQALDTFEAR

SEQ ID NO: 84908 - protein, 16 aa, Homo sapiens
  Payload ID: 16890
  Gene Symbol: SULT6B1
  Gene Name: sulfotransferase family, cytosolic, 6B, member 1
  ENSP ID: ENSP00000416947
MCTSETFQALDTFEAR

SEQ ID NO: 84909 - protein, 303 aa, Homo sapiens
  Payload ID: 16890
  Gene Symbol: SULT6B1
  Gene Name: sulfotransferase family, cytosolic, 6B, member 1
  Uniprot ID: Q6IMI4
  ENSP ID: ENSP00000444081
MADKSKFIEYIDEALEKSKETALSHLFFTYQGIPYPITMCTSETFQALDTFEARHDDIVLASYPKCGSNWILHIVSELIYAVSKKKYKYPEFPVLECGDSEKYQRMKGFPSPRILATHLHYDKLPGSIFENKAKILVIFRNPKDTAVSFLHFHNDVPDIPSYGSWDEFFRQFMKGQVSWGRYFDFAINWNKHLDGDNVKFILYEDLKENLAAGIKQIAEFLGFFLTGEQIQTISVQSTFQAMRAKSQDTHGAVGPFLFRKGEVGDWKNLFSEIQNQEMDEKFKECLAGTSLGAKLKYESYCQG

SEQ ID NO: 84910 - protein, 212 aa, Homo sapiens
  Payload ID: 16891
  Gene Symbol: SENP8
  Gene Name: SUMO/sentrin peptidase family member, NEDD8 specific
  Uniprot ID: Q96LD8
  ENSP ID: ENSP00000340505
MDPVVLSYMDSLLRQSDVSLLDPPSWLNDHIIGFAFEYFANSQFHDCSDHVSFISPEVTQFIKCTSNPAEIAMFLEPLDLPNKRVVFLAINDNSNQAAGGTHWSLLVYLQDKNSFFHYDSHSRSNSVHAKQVAEKLEAFLGRKGDKLAFVEEKAPAQQNSYDCGMYVICNTEALCQNFFRQQTESLLQLLTPAYITKKRGEWKDLITTLAKK

SEQ ID NO: 84911 - protein, 212 aa, Homo sapiens; identical to SEQ ID NO: 84910
  Payload ID: 16891
  Gene Symbol: SENP8
  Gene Name: SUMO/sentrin peptidase family member, NEDD8 specific
  Uniprot ID: Q96LD8
  ENSP ID: ENSP00000446057

SEQ ID NO: 84912 - protein, 73 aa, Homo sapiens
  Payload ID: 16891
  Gene Symbol: SENP8
  Gene Name: SUMO/sentrin peptidase family member, NEDD8 specific
  ENSP ID: ENSP00000456567
MDPVVLSYMDSLLRQSDVSLLDPPSWLNDHIIGFAFEYFANSQFHDCSDHVSFISPEVTQFIKCTSNPAEIAM

SEQ ID NO: 84913 - protein, 37 aa, Homo sapiens
  Payload ID: 16891
  Gene Symbol: SENP8
  Gene Name: SUMO/sentrin peptidase family member, NEDD8 specific
  ENSP ID: ENSP00000457208
MDPVVLSYMDSLLRQSDVSLLDPPSWLNDHIIGFAFE

SEQ ID NO: 84914 - protein, 130 aa, Homo sapiens
  Payload ID: 16891
  Gene Symbol: SENP8
  Gene Name: SUMO/sentrin peptidase family member, NEDD8 specific
  ENSP ID: ENSP00000457215
MDPVVLSYMDSLLRQSDVSLLDPPSWLNDHIIGFAFEYFANSQFHDCSDHVSFISPEVTQFIKCTSNPAEIAMFLEPLDLPNKRVVFLAINDNSNQAAGGTHWSLLVYLQDKNSFFHYDSHSRSNSVHAK

SEQ ID NO: 84915 - protein, 346 aa, Homo sapiens
  Payload ID: 16892
  Gene Symbol: SAE1
  Gene Name: SUMO1 activating enzyme subunit 1
  Uniprot ID: Q9UBE0
  ENSP ID: ENSP00000270225
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQVLLKFRTDKGRDPSSDTYEEDSELLLQIRNDVLDSLGISPDLLPEDFVRYCFSEMAPVCAVVGGILAQEIVKALSQRDPPHNNFFFFDGMKGNGIVECLGPK

SEQ ID NO: 84916 - protein, 299 aa, Homo sapiens
  Payload ID: 16892
  Gene Symbol: SAE1
  Gene Name: SUMO1 activating enzyme subunit 1
  ENSP ID: ENSP00000398818
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQELFPRIVERVYAQRHPRSTERTHAKMLIPFLTKEKPGFLGEMAVSRSGVGKLQCS

SEQ ID NO: 84917 - protein, 299 aa, Homo sapiens
  Payload ID: 16892
  Gene Symbol: SAE1
  Gene Name: SUMO1 activating enzyme subunit 1
  Uniprot ID: Q9UBE0
  ENSP ID: ENSP00000416557
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQGPVSAGPSSQQLLLLRWHEGEWDCGVPWPQVNSRFGSPRDANCSMPTCIPCPLPS

SEQ ID NO: 84918 - protein, 266 aa, Homo sapiens
  Payload ID: 16892
  Gene Symbol: SAE1
  Gene Name: SUMO1 activating enzyme subunit 1
  Uniprot ID: Q9UBE0
  ENSP ID: ENSP00000440818
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQGTASPRWPQCVRWLEGFWHRKL

SEQ ID NO: 84919 - protein, 205 aa, Homo sapiens
  Payload ID: 16892
  Gene Symbol: SAE1
  Gene Name: SUMO1 activating enzyme subunit 1
  ENSP ID: ENSP00000468931
MLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTT

SEQ ID NO: 84920 - protein, 133 aa, Homo sapiens
  Payload ID: 16892
  Gene Symbol: SAE1
  Gene Name: SUMO1 activating enzyme subunit 1
  ENSP ID: ENSP00000469938
MLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRA

SEQ ID NO: 84921 - protein, 71 aa, Homo sapiens
  Payload ID: 16892
  Gene Symbol: SAE1
  Gene Name: SUMO1 activating enzyme subunit 1
  ENSP ID: ENSP00000469978
MVDVKVDTEDIEKKPESFFTQFDAVCLTCCSRDVIVKVDQICHKNSIKFFTGDVFGYHGYTFANLGEHEFV

SEQ ID NO: 84922 - protein, 265 aa, Homo sapiens
  Payload ID: 16892
  Gene Symbol: SAE1
  Gene Name: SUMO1 activating enzyme subunit 1
  ENSP ID: ENSP00000470741
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAKVVFCPVKEALEVDWSSEKAKAALKRTTSDYFLLQVLLKFRTDKGRDPSSDTYEEDSELLLQIRNDVLDSLGISPDLLPEDFVRYCFSEMAPVCAVVGGILAQEIVKALSQRDPPHNNFFFFDGMKGNGIVECLGPK

SEQ ID NO: 84923 - protein, 157 aa, Homo sapiens
  Payload ID: 16892
  Gene Symbol: SAE1
  Gene Name: SUMO1 activating enzyme subunit 1
  ENSP ID: ENSP00000471010
MLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALE

SEQ ID NO: 84924 - protein, 98 aa, Homo sapiens
  Payload ID: 16892
  Gene Symbol: SAE1
  Gene Name: SUMO1 activating enzyme subunit 1
  ENSP ID: ENSP00000472389
MLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYH

SEQ ID NO: 84925 - protein, 50 aa, Homo sapiens
  Payload ID: 16892
  Gene Symbol: SAE1
  Gene Name: SUMO1 activating enzyme subunit 1
  ENSP ID: ENSP00000473037
MVEKEEAGGGISEEEAAQYDRQIRLWGLEAQKRSGPARLEAARVWRGRLF

SEQ ID NO: 84926 - protein, 644 aa, Homo sapiens
  Payload ID: 16893
  Gene Symbol: SENP1
  Gene Name: SUMO1/sentrin specific peptidase 1
  Uniprot ID: Q9P0U3
  ENSP ID: ENSP00000394791
MDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQEIPQQMNGSDCGMFACKYADCITKDRPINFTQQHMPYFRKRMVWEILHRKLL

SEQ ID NO: 84927 - protein, 644 aa, Homo sapiens; identical to SEQ ID NO: 84926
  Payload ID: 16893
  Gene Symbol: SENP1
  Gene Name: SUMO1/sentrin specific peptidase 1
  Uniprot ID: Q9P0U3
  ENSP ID: ENSP00000447328

SEQ ID NO: 84928 - protein, 130 aa, Homo sapiens
  Payload ID: 16893
  Gene Symbol: SENP1
  Gene Name: SUMO1/sentrin specific peptidase 1
  ENSP ID: ENSP00000447593
MDDIADRMRMDAGEVTLVNHNSVFKTHLLPQTGFPEDQLSLSDQQILSSRQGHLDRSFTCSTRSAAYNPSYYSGPGLGVLARYSWGKMLTFGGHHGVTLMQIRHMAVAGFSSFINFQIILPQTVFLAQAI

SEQ ID NO: 84929 - protein, 142 aa, Homo sapiens
  Payload ID: 16893
  Gene Symbol: SENP1
  Gene Name: SUMO1/sentrin specific peptidase 1
  ENSP ID: ENSP00000448597
MRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKS

SEQ ID NO: 84930 - protein, 643 aa, Homo sapiens
  Payload ID: 16893
  Gene Symbol: SENP1
  Gene Name: SUMO1/sentrin specific peptidase 1
  Uniprot ID: Q9P0U3
  ENSP ID: ENSP00000450076
MDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQIPQQMNGSDCGMFACKYADCITKDRPINFTQQHMPYFRKRMVWEILHRKLL

SEQ ID NO: 84931 - protein, 755 aa, Homo sapiens
  Payload ID: 16894
  Gene Symbol: SENP5
  Gene Name: SUMO1/sentrin specific peptidase 5
  Uniprot ID: Q96HI0
  ENSP ID: ENSP00000327197
MKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQYCKCLALEQPFQFSQEDMPRVRKRIYKELCECRLMD

SEQ ID NO: 84932 - protein, 709 aa, Homo sapiens
  Payload ID: 16894
  Gene Symbol: SENP5
  Gene Name: SUMO1/sentrin specific peptidase 5
  Uniprot ID: Q96HI0
  ENSP ID: ENSP00000390231
MKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKNIRKYLLTEAREKNRPEFLQGWQTAVTKCIPQQKNDSDCGVFVLQYCKCLALEQPFQFSQEDMPRVRKRIYKELCECRLMD

SEQ ID NO: 84933 - protein, 245 aa, Homo sapiens
  Payload ID: 16894
  Gene Symbol: SENP5
  Gene Name: SUMO1/sentrin specific peptidase 5
  ENSP ID: ENSP00000396927
MKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQYCKCLALEQPFQFSQEDMPRVRKRIYKELCECRLMD

SEQ ID NO: 84934 - protein, 98 aa, Homo sapiens
  Payload ID: 16894
  Gene Symbol: SENP5
  Gene Name: SUMO1/sentrin specific peptidase 5
  ENSP ID: ENSP00000405663
  MOD_RES (1)..(1): Any amino acid
XLFKKSLLLIPIHLEVHWSLITVTLSNRIISFYDSQGIHFKFCVECIPQQKNDSDCGVFVLQYCKCLALEQPFQFSQEDMPRVRKRIYKELCECRLMD

SEQ ID NO: 84935 - protein, 77 aa, Homo sapiens
  Payload ID: 16894
  Gene Symbol: SENP5
  Gene Name: SUMO1/sentrin specific peptidase 5
  ENSP ID: ENSP00000415227
  MOD_RES (1)..(1): Any amino acid
XLTEAREKNRPEFLQGWQTAVTKCIPQQKNDSDCGVFVLQYCKCLALEQPFQFSQEDMPRVRKRIYKELCGWREEGR

SEQ ID NO: 84936 - protein, 685 aa, Homo sapiens
  Payload ID: 16895
  Gene Symbol: SENP6
  Gene Name: SUMO1/sentrin specific peptidase 6
  ENSP ID: ENSP00000321820
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLK

SEQ ID NO: 84937 - protein, 1105 aa, Homo sapiens
  Payload ID: 16895
  Gene Symbol: SENP6
  Gene Name: SUMO1/sentrin specific peptidase 6
  Uniprot ID: Q9GZR1
  ENSP ID: ENSP00000359027
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 84938 - protein, 582 aa, Homo sapiens
  Payload ID: 16895
  Gene Symbol: SENP6
  Gene Name: SUMO1/sentrin specific peptidase 6
  ENSP ID: ENSP00000391426
LSNNKKLSENTQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLK

SEQ ID NO: 84939 - protein, 1112 aa, Homo sapiens
  Payload ID: 16895
  Gene Symbol: SENP6
  Gene Name: SUMO1/sentrin specific peptidase 6
  Uniprot ID: Q9GZR1
  ENSP ID: ENSP00000402527
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 84940 - protein, 388 aa, Homo sapiens
  Payload ID: 16895
  Gene Symbol: SENP6
  Gene Name: SUMO1/sentrin specific peptidase 6
  ENSP ID: ENSP00000422576
  MOD_RES (1)..(1): Any amino acid
XRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAWLKQNQTKL

SEQ ID NO: 84941 - protein, 74 aa, Homo sapiens
  Payload ID: 16895
  Gene Symbol: SENP6
  Gene Name: SUMO1/sentrin specific peptidase 6
  ENSP ID: ENSP00000425624
MAAGKSGGSAGEITFLEALARSESKRDGGFKNNWSFDHEEESEGDTDKECFTSVWATAPFIITTLCAFTDEMLI

SEQ ID NO: 84942 - protein, 220 aa, Homo sapiens
  Payload ID: 16895
  Gene Symbol: SENP6
  Gene Name: SUMO1/sentrin specific peptidase 6
  ENSP ID: ENSP00000426480
MLSNNKKLSENTQNTSLCSGTVVHGRRFHHAHAQIPVVKTAAQSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLND

SEQ ID NO: 84943 - protein, 984 aa, Homo sapiens
  Payload ID: 16896
  Gene Symbol: SENP7
  Gene Name: SUMO1/sentrin specific peptidase 7
  Uniprot ID: Q9BQF6
  ENSP ID: ENSP00000313624
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 84944 - protein, 1017 aa, Homo sapiens
  Payload ID: 16896
  Gene Symbol: SENP7
  Gene Name: SUMO1/sentrin specific peptidase 7
  Uniprot ID: Q9BQF6
  ENSP ID: ENSP00000342159
MLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 84945 - protein, 238 aa, Homo sapiens
  Payload ID: 16896
  Gene Symbol: SENP7
  Gene Name: SUMO1/sentrin specific peptidase 7
  Uniprot ID: Q9BQF6
  ENSP ID: ENSP00000377647
MKKFLYIKSVFHTLRMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 84946 - protein, 886 aa, Homo sapiens
  Payload ID: 16896
  Gene Symbol: SENP7
  Gene Name: SUMO1/sentrin specific peptidase 7
  Uniprot ID: Q9BQF6
  ENSP ID: ENSP00000377651
MLNAKPEDVHVQSPLSKFRSSERWTLPLQWERSLRNKVISLDHKNKKHIRGCPVTSKSSPERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 84947 - protein, 985 aa, Homo sapiens
  Payload ID: 16896
  Gene Symbol: SENP7
  Gene Name: SUMO1/sentrin specific peptidase 7
  ENSP ID: ENSP00000377654
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 84948 - protein, 1050 aa, Homo sapiens
  Payload ID: 16896
  Gene Symbol: SENP7
  Gene Name: SUMO1/sentrin specific peptidase 7
  Uniprot ID: Q9BQF6
  ENSP ID: ENSP00000377655
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSVDSLETCQKLEPLRQSLNLSERIPRVILTNVLGTELGRKYIRTPPVTEGSLSDTDNLQSEQLSSSSDGSLESYQNLNPHKSCYLSERGSQRSKTVDDNSAKQTAHNKEKRRKDDGISLLISDTQPEDLNSGSRGCDHLEQESRNKDVKYSDSKVELTLISRKTKRRLRNNLPDSQYCTSLDKSTEQTKKQEDDSTISTEFEKPSENYHQDPKLPEEITTKPTKSDFTKLSSLNSQELTLSNATKSASAGSTTETVENSNSIDIVGISSLVEKDENELNTIEKPILRGHNEGNQSLISAEPIVVSSDEEGPVEHKSSEILKLQSKQDRETTNENESTSESALLELPLITCESVQMSSELCPYNPVMENISSIMPSNEMDLQLDFIFTSVYIGKIKGASKGCVTITKKYIKIPFQVSLNEISLLVDTTHLKRFGLWKSKDDNHSKRSHAILFFWVSSDYLQEIQTQLEHSVLSQQSKSSEFIFLELHNPVSQREELKLKDIMTEISIISGELELSYPLSWVQAFPLFQNLSSKESSFIHYYCVSTCSFPAGVAVAEEMKLKSVSQPSNTDAAKPTYTFLQKQSSGCYSLSITSNPDEEWREVRHTGLVQKLIVYPPPPTKGGLGVTNEDLECLEEGEFLNDVIIDFYLKYLILEKASDELVERSHIFSSFFYKCLTRKENNLTEDNPNLSMAQRRHKRVRTWTRHINIFNKDYIFVPVNESSHWYLAVICFPWLEEAVYEDFPQTVSQQSQAQQSQNDNKTIDNDLRTTSTLSLSAEDSQSTESNMSVPKKMCKRPCILILDSLKAASVQNTVQNLREYLEVEWEVKLKTHRQFSKTNMVDLCPKVPKQDNSSDCGVYLLQYVESFFKDPIVNFELPIHLEKWFPRHVIKTKREDIRELILKLHLQQQKGSSS

SEQ ID NO: 84949 - protein, 50 aa, Homo sapiens
  Payload ID: 16896
  Gene Symbol: SENP7
  Gene Name: SUMO1/sentrin specific peptidase 7
  ENSP ID: ENSP00000402977
  MOD_RES (1)..(1): Any amino acid
XIQTQLEHSVLSQQYGVSLCHPGWSAVALSLLTASSASRVHAILLPQPPE

SEQ ID NO: 84950 - protein, 589 aa, Homo sapiens
  Payload ID: 16897
  Gene Symbol: SENP2
  Gene Name: SUMO1/sentrin/SMT3 specific peptidase 2
  Uniprot ID: Q9HC62
  ENSP ID: ENSP00000296257
MYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKLLERLKESGHGNSVCPVTSNYHSSQRSQMDTLKTKGWGEEQNHGVKTTQFVPKQYRLVETRGPLCSLRSEKRCSKGKITDTETMVGIRFENESRRGYQLEPDLSEEVSARLRLGSGSNGLLRRKVSIIETKEKNCSGKERDRRTDDLLELTEDMEKEISNALGHGPQDEILSSAFKLRITRGDIQTLKNYHWLNDEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIPQQLNGSDCGMFTCKYADYISRDKPITFTQHQMPLFRKKMVWEILHQQLL

SEQ ID NO: 84951 - protein, 104 aa, Homo sapiens
  Payload ID: 16897
  Gene Symbol: SENP2
  Gene Name: SUMO1/sentrin/SMT3 specific peptidase 2
  ENSP ID: ENSP00000388893
MYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVINLLME

SEQ ID NO: 84952 - protein, 60 aa, Homo sapiens
  Payload ID: 16897
  Gene Symbol: SENP2
  Gene Name: SUMO1/sentrin/SMT3 specific peptidase 2
  ENSP ID: ENSP00000390229
MYRWLVRILGTIFRFCDRSVPPARALLKRRRSDSTLFSTVDTDEIPAKRPRLGIFELFIL

SEQ ID NO: 84953 - protein, 105 aa, Homo sapiens
  Payload ID: 16897
  Gene Symbol: SENP2
  Gene Name: SUMO1/sentrin/SMT3 specific peptidase 2
  ENSP ID: ENSP00000393197
MYRWLVRILGTIFRFCDRSVPPARALLKRRRSDSTLFSTVDTDEIPAKRPRLDCFIHQVKNSLYNAASLFGFPFQLTTKPMVTSACNGTRNVAPSGEVLDPGTTC

SEQ ID NO: 84954 - protein, 273 aa, Homo sapiens
  Payload ID: 16897
  Gene Symbol: SENP2
  Gene Name: SUMO1/sentrin/SMT3 specific peptidase 2
  ENSP ID: ENSP00000399156
MRLCPSCSTRLQIIQAKGRNLNVLVTPYGLGILPWPSSKALLGPGKAVAVVGLGLRIIPLLGQWMDSHPCLYCGPQDSEGTNWQTSPSTLFSTVDTDEIPAKRPRLDCFIHQVKNSLYNAASLFGFPFQLTTKPMVTSACNGTRNVAPSGEVFSNSSSCELTGSGSWNNMLKLGNKSPNGISDYPKIRVTVTRDQPRRVLPSFGFTLNSEGCNRRPGGRRHSKGNPESSLMWKPQEQAVTEMISEESGKGLRRPHCTVEEGVQKEEREKYRKL

SEQ ID NO: 84955 - protein, 203 aa, Homo sapiens
  Payload ID: 16897
  Gene Symbol: SENP2
  Gene Name: SUMO1/sentrin/SMT3 specific peptidase 2
  ENSP ID: ENSP00000399201
GKITDTETMVGIRFENESRRGYQLEPDLSEEVSARLRLGSGSNGLLRRKVSIIETKEKNCSGKERDRRTDDLLELTEVINFYMNLLVERNKKQGYPALHVFSTFFYPKLKSGGYQAVKRWTKGVNLFEQEIILVPIHRKVHWSLVVIDLRKKCLKYLDSMGQKGHRICEILLQYLQDESKTKRNSDLNLLEWTHHSMKPHEIP

SEQ ID NO: 84956 - protein, 54 aa, Homo sapiens
  Payload ID: 16897
  Gene Symbol: SENP2
  Gene Name: SUMO1/sentrin/SMT3 specific peptidase 2
  ENSP ID: ENSP00000408114
MYRWLVRILGTIFRFCDRSVPPARALLKRRRSDSTLFSTVDTDEIPAKRPRLVC

SEQ ID NO: 84957 - protein, 574 aa, Homo sapiens
  Payload ID: 16898
  Gene Symbol: SENP3
  Gene Name: SUMO1/sentrin/SMT3 specific peptidase 3
  Uniprot ID: Q9H4L4
  ENSP ID: ENSP00000314029
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 84958 - protein, 574 aa, Homo sapiens; identical to SEQ ID NO: 84957
  Payload ID: 16898
  Gene Symbol: SENP3
  Gene Name: SUMO1/sentrin/SMT3 specific peptidase 3
  Uniprot ID: Q9H4L4
  ENSP ID: ENSP00000403712

SEQ ID NO: 84959 - protein, 82 aa, Homo sapiens
  Payload ID: 16898
  Gene Symbol: SENP3
  Gene Name: SUMO1/sentrin/SMT3 specific peptidase 3
  ENSP ID: ENSP00000462461
VDIFNKELLLIPIHLEVHWSLISVDVRRRTITYFDSQRTLNRRCPKYCKHLALSQPFSFTQQDMPKLRRQIYKELCHCKLTV

SEQ ID NO: 84960 - protein, 237 aa, Homo sapiens
  Payload ID: 16898
  Gene Symbol: SENP3
  Gene Name: SUMO1/sentrin/SMT3 specific peptidase 3
  ENSP ID: ENSP00000463358
EHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 84961 - protein, 110 aa, Homo sapiens
  Payload ID: 16898
  Gene Symbol: SENP3
  Gene Name: SUMO1/sentrin/SMT3 specific peptidase 3
  ENSP ID: ENSP00000464172
VDIFNKELLLIPIHLEVHWSLISVDVRRRTITYFDSQRTLNRRCPKHIAKYLQAEAVKKDRLDFHQGWKGYFKMYCKHLALSQPFSFTQQDMPKLRRQIYKELCHCKLTV

SEQ ID NO: 84962 - protein, 177 aa, Homo sapiens
  Payload ID: 16898
  Gene Symbol: SENP3
  Gene Name: SUMO1/sentrin/SMT3 specific peptidase 3
  ENSP ID: ENSP00000479187
FYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTVGVWPCGLGGAVILPLPRAGSRKSVLGVVGGQ

SEQ ID NO: 84963 - protein, 63 aa, Homo sapiens
  Payload ID: 16898
  Gene Symbol: SENP3
  Gene Name: SUMO1/sentrin/SMT3 specific peptidase 3
  ENSP ID: ENSP00000482398
  MOD_RES (1)..(1): Any amino acid
XQSYQRMPGNAMVRGFRVAYKRHVLTMDDLGTLYGQNWLNDQLPPIFSPGDEHVWRPGHGHSP

SEQ ID NO: 84964 - protein, 333 aa, Homo sapiens
  Payload ID: 16899
  Gene Symbol: SIMC1
  Gene Name: SUMO-interacting motifs containing 1
  Uniprot ID: Q8NDZ2
  ENSP ID: ENSP00000331311
MPRSFEQVIILKKWFLKPYKGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 84965 - protein, 457 aa, Homo sapiens
  Payload ID: 16899
  Gene Symbol: SIMC1
  Gene Name: SUMO-interacting motifs containing 1
  Uniprot ID: Q8NDZ2
  ENSP ID: ENSP00000342075
MEDFIVISDDSGSESSGGARPGRSRRPRRALSRTSGALPRRTVNKGQKLEPIPHRRLRMVTNTIEENFPLGTVQFLMDFVSPQHYPPREIVAHIIQKILLSGSETVDVLKEAYMLLMKIQQLHPANAKTVEWDWKLLTYVMEEEGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 84966 - protein, 872 aa, Homo sapiens
  Payload ID: 16899
  Gene Symbol: SIMC1
  Gene Name: SUMO-interacting motifs containing 1
  Uniprot ID: Q8NDZ2
  ENSP ID: ENSP00000406571
MAPASASGEDLRKLPTMAEVNGEQDFIDLTRETRPRTKDRSGLYVIDLTRAEGENRPIATLDLTLEPVTPSQKEPTSLQTCASLSGKAVMEGHVDRSSQPTARRIINSDPVDLDLVEENTFVGPPPATSISGGSVYPTEPNCSSATFTGNLSFLASLQLSSDVSSLSPTSNNSRSSSSSSNQKAPLPCPQQDVSRPPQALPCPLRPLPCPPRASPCPPRASSCPPRALSCPSQTMQCQLPALTHPPQEVPCPRQNIPGPPQDSLGLPQDVPGLPQSILHPQDVAYLQDMPRSPGDVPQSPSDVSPSPDAPQSPGGMPHLPGDVLHSPGDMPHSSGDVTHSPRDIPHLPGDRPDFTQNDVQNRDMPMDISALSSPSCSPSPQSETPLEKVPWLSVMETPARKEISLSEPAKPGSAHVQSRTPQGGLYNRPCLHRLKYFLRPPVHHLFFQTLIPDKDTRENKGQKLEPIPHRRLRMVTNTIEENFPLGTVQFLMDFVSPQHYPPREIVAHIIQKILLSGSETVDVLKEAYMLLMKIQQLHPANAKTVEWDWKLLTYVMEEEGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 84967 - protein, 457 aa, Homo sapiens; identical to SEQ ID NO: 84965
  Payload ID: 16899
  Gene Symbol: SIMC1
  Gene Name: SUMO-interacting motifs containing 1
  Uniprot ID: Q8NDZ2
  ENSP ID: ENSP00000409287

SEQ ID NO: 84968 - protein, 891 aa, Homo sapiens
  Payload ID: 16899
  Gene Symbol: SIMC1
  Gene Name: SUMO-interacting motifs containing 1
  ENSP ID: ENSP00000410552
MEDFIVISDDSGSESSGGARPGRSRRPRRALSRTSGALPRRTVDFIDLTRETRPRTKDRSGLYVIDLTRAEGENRPIATLDLTLEPVTPSQKEPTSLQTCASLSGKAVMEGHVDRSSQPTARRIINSDPVDLDLVEENTFVGPPPATSISGGSVYPTEPNCSSATFTGNLSFLASLQLSSDVSSLSPTSNNSRSSSSSSNQKAPLPCPQQDVSRPPQALPCPLRPLPCPPRASPCPPRASSCPPRALSCPSQTMQCQLPALTHPPQEVPCPRQNIPGPPQDSLGLPQDVPGLPQSILHPQDVAYLQDMPRSPGDVPQSPSDVSPSPDAPQSPGGMPHLPGDVLHSPGDMPHSSGDVTHSPRDIPHLPGDRPDFTQNDVQNRDMPMDISALSSPSCSPSPQSETPLEKVPWLSVMETPARKEISLSEPAKPGSAHVQSRTPQGGLYNRPCLHRLKYFLRPPVHHLFFQTLIPDKDTRENKGQKLEPIPHRRLRMVTNTIEENFPLGTVQFLMDFVSPQHYPPREIVAHIIQKILLSGSETVDVLKEAYMLLMKIQQLHPANAKTVEWDWKLLTYVMEEEGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 84969 - protein, 1254 aa, Homo sapiens
  Payload ID: 16900
  Gene Symbol: SUCO
  Gene Name: SUN domain containing ossification factor
  Uniprot ID: Q9UBS9
  ENSP ID: ENSP00000263688
MKKHRRALALVSCLFLCSLVWLPSWRVCCKESSSASASSYYSQDDNCALENEDVQFQKKDEREGPINAESLGKSGSNLPISPKEHKLKDDSIVDVQNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKMFIKYIKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 84970 - protein, 1405 aa, Homo sapiens
  Payload ID: 16900
  Gene Symbol: SUCO
  Gene Name: SUN domain containing ossification factor
  Uniprot ID: Q9UBS9
  ENSP ID: ENSP00000356696
MRGFLARPFLSTNQHLAQWGSPLPQGKGLVQLPSQHTRHSRPFHELCSKEENSATVPKLISLVVSSETIDFSNKTMDSRRDWEREKRILEGKLQLPKALARTQRARDEGRAWTSRWLQRRRSPESCEAPLSAPLWGPQRGLPGREPLRSRSASAIALRTIGHILALLLRLLHLGLGSGGCREDVPPSGRGKKEEKMKKHRRALALVSCLFLCSLVWLPSWRVCCKESSSASASSYYSQDDNCALENEDVQFQKKNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 84971 - protein, 883 aa, Homo sapiens
  Payload ID: 16900
  Gene Symbol: SUCO
  Gene Name: SUN domain containing ossification factor
  ENSP ID: ENSP00000476704
MKKHRRALALVSCLFLCSLVWLPSWRVCCKESSSASASSYYSQDDNCALENEDVQFQKKNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKMFIKYIKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 84972 - protein, 1405 aa, Homo sapiens; identical to SEQ ID NO: 84970
  Payload ID: 16900
  Gene Symbol: SUCO
  Gene Name: SUN domain containing ossification factor
  Uniprot ID: Q9UBS9
  ENSP ID: ENSP00000477484

SEQ ID NO: 84973 - protein, 691 aa, Homo sapiens
  Payload ID: 16900
  Gene Symbol: SUCO
  Gene Name: SUN domain containing ossification factor
  ENSP ID: ENSP00000479061
MEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 84974 - protein, 1042 aa, Homo sapiens
  Payload ID: 16901
  Gene Symbol: SKIV2L2
  Gene Name: superkiller viralicidic activity 2-like 2 (S. cerevisiae)
  Uniprot ID: P42285
  ENSP ID: ENSP00000230640
MADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 84975 - protein, 88 aa, Homo sapiens
  Payload ID: 16901
  Gene Symbol: SKIV2L2
  Gene Name: superkiller viralicidic activity 2-like 2 (S. cerevisiae)
  ENSP ID: ENSP00000422125
  MOD_RES (1)..(1): Any amino acid
XKRFDGKLQSESTNNGKNKRDVDFEGTDEPIFGKKPRIEESITEDLSLADLMPRVKVQSVETVEGCTHEVCHCIGLKGKAACNIYQPN

SEQ ID NO: 84976 - protein, 89 aa, Homo sapiens
  Payload ID: 16901
  Gene Symbol: SKIV2L2
  Gene Name: superkiller viralicidic activity 2-like 2 (S. cerevisiae)
  ENSP ID: ENSP00000425042
MADAFGDELFSVFEGDSTTAAGTKKDKEKDKGKWKGPPGSADKAGLHFLQKRIIYHLNHELEKLLRNTRSFLMLFKERPFSVLTIISLF

SEQ ID NO: 84977 - protein, 72 aa, Homo sapiens
  Payload ID: 16901
  Gene Symbol: SKIV2L2
  Gene Name: superkiller viralicidic activity 2-like 2 (S. cerevisiae)
  ENSP ID: ENSP00000426641
  MOD_RES (1)..(1): Any amino acid
XLMDVVYTWATGATFAHICKMTDVFEGSIIRCMRRLEELLRQMCQAAKAIGNTELENKFAEGQYQMDKLFLI

SEQ ID NO: 84978 - protein, 154 aa, Homo sapiens [sequence omitted]

SEQ ID NO: 84979 - protein, 135 aa, Homo sapiens
  Payload ID: 16902
  Gene Symbol: SOD1
  Gene Name: superoxide dismutase 1, soluble
  ENSP ID: ENSP00000374645
MATKAESNGPVKVWGSIKGLTEGLHGFHVHEFGDNTAGCTSAGPHFNPLSRKHGGPKDEERHVGDLGNVTADKDGVADVSIEDSVISLSGDHCIIGRTLVVHEKADDLGKGGNEESTKTGNAGSRLACGVIGIAQ

SEQ ID NO: 84980 - protein, 183 aa, Homo sapiens
  Payload ID: 16903
  Gene Symbol: SOD2
  Gene Name: superoxide dismutase 2, mitochondrial
  ENSP ID: ENSP00000337127
MLSRAVCGTSRQLAPVLGYLGSRQKHSLPDLPYDYGALEPHINAQIMQLHHSKHHAAYVNNLNVTEEKYQEALAKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 84981 - protein, 183 aa, Homo sapiens; identical to SEQ ID NO: 84980
  Payload ID: 16903
  Gene Symbol: SOD2
  Gene Name: superoxide dismutase 2, mitochondrial
  ENSP ID: ENSP00000356021

SEQ ID NO: 84982 - protein, 222 aa, Homo sapiens
  Payload ID: 16903
  Gene Symbol: SOD2
  Gene Name: superoxide dismutase 2, mitochondrial
  ENSP ID: ENSP00000356022
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 84983 - protein, 61 aa, Homo sapiens
  Payload ID: 16903
  Gene Symbol: SOD2
  Gene Name: superoxide dismutase 2, mitochondrial
  ENSP ID: ENSP00000384196
MQLHHSKHHAAYVNNLNVTEEKYQEALAKGELLEAIKRDFGSFDKFKEKLTAASVGVQGSG

SEQ ID NO: 84984 - protein, 162 aa, Homo sapiens
  Payload ID: 16903
  Gene Symbol: SOD2
  Gene Name: superoxide dismutase 2, mitochondrial
  ENSP ID: ENSP00000404804
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGLIPLLGIDVWEHAYYLQYKNVRPDYLKAIWNVINWENVTERYMACKK

SEQ ID NO: 84985 - protein, 140 aa, Homo sapiens
  Payload ID: 16903
  Gene Symbol: SOD2
  Gene Name: superoxide dismutase 2, mitochondrial
  ENSP ID: ENSP00000406713
MLSRAVCGTSRQLAPVLGYLGSRQKHSLPDLPYDYGALEPHINAQIMQLHHSKHHAAYVNNLNVTEEKYQEALAKGRFQAERREAVPGRGDPREPGPIRTGLSVEENSLRICTGSEFSRHDSLSFKHMVYLIVEGVPRWV

SEQ ID NO: 84986 - protein, 111 aa, Homo sapiens
  Payload ID: 16903
  Gene Symbol: SOD2
  Gene Name: superoxide dismutase 2, mitochondrial
  ENSP ID: ENSP00000439191
MQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERG

SEQ ID NO: 84987 - protein, 141 aa, Homo sapiens
  Payload ID: 16903
  Gene Symbol: SOD2
  Gene Name: superoxide dismutase 2, mitochondrial
  ENSP ID: ENSP00000440131
MLSRAVCGTSRQLAPVLGYLGSRQKHSLPDLPYDYGALEPHINAQIMQLHHSKHHAAYVNNLNVTEEKYQEALAKGRFQAERREAVPGRGDPREPGPIRTGLSVEENSLRICTGSEFSRRCYSPDSSSACTEVQWWWSYQS

SEQ ID NO: 84988 - protein, 190 aa, Homo sapiens
  Payload ID: 16903
  Gene Symbol: SOD2
  Gene Name: superoxide dismutase 2, mitochondrial
  ENSP ID: ENSP00000441362
MFAFWPTHRRVAFQAWPQSLARRRTPPGEESTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQ

SEQ ID NO: 84989 - protein, 176 aa, Homo sapiens
  Payload ID: 16903
  Gene Symbol: SOD2
  Gene Name: superoxide dismutase 2, mitochondrial
  Uniprot ID: P04179
  ENSP ID: ENSP00000442920
MQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 84990 - protein, 183 aa, Homo sapiens
  Payload ID: 16903
  Gene Symbol: SOD2
  Gene Name: superoxide dismutase 2, mitochondrial
  ENSP ID: ENSP00000445015
MLPRVGGPGATSRERPWAASRGRLLLAEAHLTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQ

SEQ ID NO: 84991 - protein, 222 aa, Homo sapiens; identical to SEQ ID NO: 84982
  Payload ID: 16903
  Gene Symbol: SOD2
  Gene Name: superoxide dismutase 2, mitochondrial
  ENSP ID: ENSP00000446252

SEQ ID NO: 84992 - protein, 240 aa, Homo sapiens
  Payload ID: 16904
  Gene Symbol: SOD3
  Gene Name: superoxide dismutase 3, extracellular
  Uniprot ID: P08294
  ENSP ID: ENSP00000371554
MLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 84993 - protein, 54 aa, Homo sapiens
  Payload ID: 16904
  Gene Symbol: SOD3
  Gene Name: superoxide dismutase 3, extracellular
  ENSP ID: ENSP00000472134
MLALLCSCLLLAAGASDAWTGEDSAEPNSDSAEWIRDMYAKVTEIWQEVMQRRD

SEQ ID NO: 84994 - protein, 2214 aa, Homo sapiens
  Payload ID: 16905
  Gene Symbol: SVIL
  Gene Name: supervillin
  Uniprot ID: O95425
  ENSP ID: ENSP00000348128
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHVCESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 84995 - protein, 2182 aa, Homo sapiens
  Payload ID: 16905
  Gene Symbol: SVIL
  Gene Name: supervillin
  Uniprot ID: O95425
  ENSP ID: ENSP00000364547
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHVCESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 84996 - protein, 1788 aa, Homo sapiens
  Payload ID: 16905
  Gene Symbol: SVIL
  Gene Name: supervillin
  Uniprot ID: O95425
  ENSP ID: ENSP00000364549
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPRCTSHSETPTVDDEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 84997 - protein, 963 aa, Homo sapiens
  Payload ID: 16905
  Gene Symbol: SVIL
  Gene Name: supervillin
  ENSP ID: ENSP00000488171
  MOD_RES (1)..(1): Any amino acid
XPQEKLCKNPCAMFAAGEIKTPTGEGLLDSPSKTMSIKERLALLKKSGEEDWRNRLSRRQEGGKAPASSLHTQEAGRSLIKKEEGGVADDSAISNLLWRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQED

SEQ ID NO: 84998 - protein, 369 aa, Homo sapiens
  Payload ID: 16906
  Gene Symbol: ST13
  Gene Name: suppression of tumorigenicity 13 (colon carcinoma) (Hsp70 interacting protein)
  Uniprot ID: P50502
  ENSP ID: ENSP00000216218
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 84999 - protein, 162 aa, Homo sapiens
  Payload ID: 16906
  Gene Symbol: ST13
  Gene Name: suppression of tumorigenicity 13 (colon carcinoma) (Hsp70 interacting protein)
  ENSP ID: ENSP00000392067
MGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWE

SEQ ID NO: 85000 - protein, 38 aa, Homo sapiens
  Payload ID: 16906
  Gene Symbol: ST13
  Gene Name: suppression of tumorigenicity 13 (colon carcinoma) (Hsp70 interacting protein)
  ENSP ID: ENSP00000397062
MDPRKVNELRAFVKMCKQDPSVLHTEEMRFLREWVERN

SEQ ID NO: 85001 - protein, 146 aa, Homo sapiens
  Payload ID: 16906
  Gene Symbol: ST13
  Gene Name: suppression of tumorigenicity 13 (colon carcinoma) (Hsp70 interacting protein)
  ENSP ID: ENSP00000412049
  MOD_RES (1)..(1): Any amino acid
XIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRVCTTTL

SEQ ID NO: 85002 - protein, 211 aa, Homo sapiens [sequence omitted]

SEQ ID NO: 85003 - protein, 254 aa, Homo sapiens
  Payload ID: 16906
  Gene Symbol: ST13
  Gene Name: suppression of tumorigenicity 13 (colon carcinoma) (Hsp70 interacting protein)
  ENSP ID: ENSP00000484210
MIKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 85004 - protein, 855 aa, Homo sapiens [sequence omitted]

SEQ ID NO: 85005 - protein, 1047 aa, Homo sapiens
  Payload ID: 16908
  Gene Symbol: ST18
  Gene Name: suppression of tumorigenicity 18, zinc finger
  Uniprot ID: O60284
  ENSP ID: ENSP00000276480
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKKNRILDKSAPLTSSNTSIPTPSSSPFKTSSILVNAAFYQALCDQEGWDTPINYSKTHGKTEEEKEKDPVSSLENLEEKKFPGEASIPSPKPKLHARDLKKELITCPTPGCDGSGHVTGNYASHRSVSGCPLADKTLKSLMAANSQELKCPTPGCDGSGHVTGNYASHRSLSGCPRARKGGVKMTPTKEEKEDPELKCPVIGCDGQGHISGKYTSHRTASGCPLAAKRQKENPLNGASLSWKLNKQELPHCPLPGCNGLGHVNNVFVTHRSLSGCPLNAQVIKKGKVSEELMTIKLKATGGIESDEEIRHLDEEIKELNESNLKIEADMMKLQTQITSMESNLKTIEEENKLIEQNNESLLKELAGLSQALISSLADIQLPQMGPISEQNFEAYVNTLTDMYSNLERDYSPECKALLESIKQAVKGIHV

SEQ ID NO: 85006 - protein, 12 aa, Homo sapiens
  Payload ID: 16908
  Gene Symbol: ST18
  Gene Name: suppression of tumorigenicity 18, zinc finger
  ENSP ID: ENSP00000428096
MDAEAEDKTLRT

SEQ ID NO: 85007 - protein, 620 aa, Homo sapiens
  Payload ID: 16908
  Gene Symbol: ST18
  Gene Name: suppression of tumorigenicity 18, zinc finger
  ENSP ID: ENSP00000428521
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKK

SEQ ID NO: 85008 - protein, 41 aa, Homo sapiens
  Payload ID: 16908
  Gene Symbol: ST18
  Gene Name: suppression of tumorigenicity 18, zinc finger
  ENSP ID: ENSP00000428920
MDAEAEDKTLRTRSKGTEVPMDSLIQELRISVPVDMRPLTW

SEQ ID NO: 85009 - protein, 94 aa, Homo sapiens
  Payload ID: 16908
  Gene Symbol: ST18
  Gene Name: suppression of tumorigenicity 18, zinc finger
  ENSP ID: ENSP00000429579
MDAEAEDKTLRTRSKGTEVPMDSLIQELSVAYDCSMAKKRTAEDQALGVPVNKRKSLLMKPRHYSPKADCQEDRSDRTEDDGPLETHGHSTRKS

SEQ ID NO: 85010 - protein, 364 aa, Homo sapiens
  Payload ID: 16908
  Gene Symbol: ST18
  Gene Name: suppression of tumorigenicity 18, zinc finger
  ENSP ID: ENSP00000430763
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHYPPIKLC

SEQ ID NO: 85011 - protein, 1137 aa, Homo sapiens
  Payload ID: 16909
  Gene Symbol: ST5
  Gene Name: suppression of tumorigenicity 5
  Uniprot ID: P78524
  ENSP ID: ENSP00000319678
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTRTGTRAHSLGIREKISAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEADKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 85012 - protein, 1137 aa, Homo sapiens; identical to SEQ ID NO: 85011
  Payload ID: 16909
  Gene Symbol: ST5
  Gene Name: suppression of tumorigenicity 5
  Uniprot ID: P78524
  ENSP ID: ENSP00000350294

SEQ ID NO: 85013 - protein, 124 aa, Homo sapiens
  Payload ID: 16909
  Gene Symbol: ST5
  Gene Name: suppression of tumorigenicity 5
  ENSP ID: ENSP00000431139
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQD

SEQ ID NO: 85014 - protein, 183 aa, Homo sapiens
  Payload ID: 16909
  Gene Symbol: ST5
  Gene Name: suppression of tumorigenicity 5
  ENSP ID: ENSP00000431252
MTSRKNGGGAHSWQETPWEQRRALGLQRAEMTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLT

SEQ ID NO: 85015 - protein, 155 aa, Homo sapiens
  Payload ID: 16909
  Gene Symbol: ST5
  Gene Name: suppression of tumorigenicity 5
  ENSP ID: ENSP00000431332
MQFVEKFQRALGLQRAEMTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQST

SEQ ID NO: 85016 - protein, 148 aa, Homo sapiens
  Payload ID: 16909
  Gene Symbol: ST5
  Gene Name: suppression of tumorigenicity 5
  ENSP ID: ENSP00000431564
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPR

SEQ ID NO: 85017 - protein, 179 aa, Homo sapiens
  Payload ID: 16909
  Gene Symbol: ST5
  Gene Name: suppression of tumorigenicity 5
  ENSP ID: ENSP00000431580
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKK

SEQ ID NO: 85018 - protein, 111 aa, Homo sapiens
  Payload ID: 16909
  Gene Symbol: ST5
  Gene Name: suppression of tumorigenicity 5
  ENSP ID: ENSP00000431673
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKR

SEQ ID NO: 85019 - protein, 95 aa, Homo sapiens
  Payload ID: 16909
  Gene Symbol: ST5
  Gene Name: suppression of tumorigenicity 5
  ENSP ID: ENSP00000431990
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFK

SEQ ID NO: 85020 - protein, 135 aa, Homo sapiens
  Payload ID: 16909
  Gene Symbol: ST5
  Gene Name: suppression of tumorigenicity 5
  ENSP ID: ENSP00000432521
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRS

SEQ ID NO: 85021 - protein, 122 aa, Homo sapiens
  Payload ID: 16909
  Gene Symbol: ST5
  Gene Name: suppression of tumorigenicity 5
  ENSP ID: ENSP00000432872
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAA

SEQ ID NO: 85022 - protein, 609 aa, Homo sapiens
  Payload ID: 16909
  Gene Symbol: ST5
  Gene Name: suppression of tumorigenicity 5
  Uniprot ID: P78524
  ENSP ID: ENSP00000432887
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 85023 - protein, 139 aa, Homo sapiens
  Payload ID: 16909
  Gene Symbol: ST5
  Gene Name: suppression of tumorigenicity 5
  ENSP ID: ENSP00000433008
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTP

SEQ ID NO: 85024 - protein, 111 aa, Homo sapiens
  Payload ID: 16909
  Gene Symbol: ST5
  Gene Name: suppression of tumorigenicity 5
  ENSP ID: ENSP00000433043
  MOD_RES (1)..(1): Any amino acid
XPASVCASSSESLPHCCWSAGSFLWQISSAASEHIPGPFWEGRSQGLVLGLAGYSSSANLGSWKRCPSCSAWGLPLAGEGRVPSPAAPTRWWPCSTPSPGSTPSFLSSRPP

SEQ ID NO: 85025 - protein, 40 aa, Homo sapiens
  Payload ID: 16909
  Gene Symbol: ST5
  Gene Name: suppression of tumorigenicity 5
  ENSP ID: ENSP00000433175
MTMTANKNSSITHGAGGTKAPRGTLSRSQSVSPPPVLSPP

SEQ ID NO: 85026 - protein, 142 aa, Homo sapiens
  Payload ID: 16909
  Gene Symbol: ST5
  Gene Name: suppression of tumorigenicity 5
  ENSP ID: ENSP00000433346
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPG

SEQ ID NO: 85027 - protein, 328 aa, Homo sapiens
  Payload ID: 16909
  Gene Symbol: ST5
  Gene Name: suppression of tumorigenicity 5
  ENSP ID: ENSP00000433349
MVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 85028 - protein, 1137 aa, Homo sapiens; identical to SEQ ID NO: 85011
  Payload ID: 16909
  Gene Symbol: ST5
  Gene Name: suppression of tumorigenicity 5
  Uniprot ID: P78524
  ENSP ID: ENSP00000433528

SEQ ID NO: 85029 - protein, 344 aa, Homo sapiens
  Payload ID: 16909
  Gene Symbol: ST5
  Gene Name: suppression of tumorigenicity 5
  ENSP ID: ENSP00000433588
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHV

SEQ ID NO: 85030 - protein, 154 aa, Homo sapiens
  Payload ID: 16909
  Gene Symbol: ST5
  Gene Name: suppression of tumorigenicity 5
  ENSP ID: ENSP00000433647
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTR

SEQ ID NO: 85031 - protein, 356 aa, Homo sapiens
  Payload ID: 16909
  Gene Symbol: ST5
  Gene Name: suppression of tumorigenicity 5
  ENSP ID: ENSP00000433793
MTSRKNGGGAHSWQETPWEQRRALGLQRAEMTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKECAFSSSSRGCWLLLISQALLK

SEQ ID NO: 85032 - protein, 145 aa, Homo sapiens
  Payload ID: 16909
  Gene Symbol: ST5
  Gene Name: suppression of tumorigenicity 5
  ENSP ID: ENSP00000433858
GRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKVPSPEAAHWSRAGGRAGSQPFSLFPGFLPSLIWTASSIPFE

SEQ ID NO: 85033 - protein, 123 aa, Homo sapiens
  Payload ID: 16909
  Gene Symbol: ST5
  Gene Name: suppression of tumorigenicity 5
  ENSP ID: ENSP00000434332
MFGAEGVLPGERALGLQRAEMTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLD

SEQ ID NO: 85034 - protein, 137 aa, Homo sapiens
  Payload ID: 16909
  Gene Symbol: ST5
  Gene Name: suppression of tumorigenicity 5
  ENSP ID: ENSP00000434701
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQPVPAQWELVRKEEP

SEQ ID NO: 85035 - protein, 74 aa, Homo sapiens
  Payload ID: 16909
  Gene Symbol: ST5
  Gene Name: suppression of tumorigenicity 5
  ENSP ID: ENSP00000434930
MTMTANKNSSITHGAGGTKAPRGTLSRSQSVSPPPVLSPPRSPIYPLSDSETSACRYPSHSSSRVLLKDRHPPA

SEQ ID NO: 85036 - protein, 144 aa, Homo sapiens
  Payload ID: 16909
  Gene Symbol: ST5
  Gene Name: suppression of tumorigenicity 5
  ENSP ID: ENSP00000434935
MTMTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPA

SEQ ID NO: 85037 - protein, 98 aa, Homo sapiens
  Payload ID: 16909
  Gene Symbol: ST5
  Gene Name: suppression of tumorigenicity 5
  ENSP ID: ENSP00000435016
  MOD_RES (1)..(1): Any amino acid
XVHIQSMLKRAPSYRTLELELLEWQERELFEYFVVVSLKKKPSRNTYLPEVSYQFPKLDRPTKQMREAEERLKAIPQFCFPDAKDWLPVSEYSPLTPP

SEQ ID NO: 85038 - protein, 717 aa, Homo sapiens
  Payload ID: 16909
  Gene Symbol: ST5
  Gene Name: suppression of tumorigenicity 5
  Uniprot ID: P78524
  ENSP ID: ENSP00000435097
MTMTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 85039 - protein, 53 aa, Homo sapiens
  Payload ID: 16909
  Gene Symbol: ST5
  Gene Name: suppression of tumorigenicity 5
  ENSP ID: ENSP00000435180
MTMTANKNSSITHGAGGTKAPRGTLSRSQSVSPPPVLSPPRSPIYPLSDSETS

SEQ ID NO: 85040 - protein, 83 aa, Homo sapiens
  Payload ID: 16909
  Gene Symbol: ST5
  Gene Name: suppression of tumorigenicity 5
  ENSP ID: ENSP00000435228
MTMTANKNSSITHGAGGTKAPRGTLSRSQSVSPPPVLSPPRSPIYPLSDSETSACRYPSHSSSRVLLKDRHPPAPSPQNPQDP

SEQ ID NO: 85041 - protein, 76 aa, Homo sapiens
  Payload ID: 16909
  Gene Symbol: ST5
  Gene Name: suppression of tumorigenicity 5
  ENSP ID: ENSP00000435292
MTMTANKNSSITHGAGGTKAPRGTLSRKSFEFEDASSLQSLYPSSPTENGTENQPKFGSKSTLEENAYEDIVGDLP

SEQ ID NO: 85042 - protein, 52 aa, Homo sapiens
  Payload ID: 16909
  Gene Symbol: ST5
  Gene Name: suppression of tumorigenicity 5
  ENSP ID: ENSP00000435562
MTMTANKNSSITHGAGGTKAPRGTLSRSQSVSPPPVLSPPRSPIYPLSDSET

SEQ ID NO: 85043 - protein, 57 aa, Homo sapiens
  Payload ID: 16909
  Gene Symbol: ST5
  Gene Name: suppression of tumorigenicity 5
  ENSP ID: ENSP00000435925
MTMTANKNSSITHGAGGTKAPRGTLSRSQSVSPPPVLSPPRSPIYPLSDSETSACRY

SEQ ID NO: 85044 - protein, 26 aa, Homo sapiens
  Payload ID: 16909
  Gene Symbol: ST5
  Gene Name: suppression of tumorigenicity 5
  ENSP ID: ENSP00000436154
MTMTANKNSSITHGAGGTKAPRGTLS

SEQ ID NO: 85045 - protein, 30 aa, Homo sapiens
  Payload ID: 16909
  Gene Symbol: ST5
  Gene Name: suppression of tumorigenicity 5
  ENSP ID: ENSP00000436363
MTMTANKNSSITHGAGGTKAPRGTLSRSQS

SEQ ID NO: 85046 - protein, 77 aa, Homo sapiens
  Payload ID: 16909
  Gene Symbol: ST5
  Gene Name: suppression of tumorigenicity 5
  ENSP ID: ENSP00000436506
MTMTANKNSSITHGAGGTKAPRGTLSRKSFEFEDASSLQSLYPSSPTENGTENQPKFGSKSTLEENAYEDIVGDLPK

SEQ ID NO: 85047 - protein, 74 aa, Homo sapiens; identical to SEQ ID NO: 85035
  Payload ID: 16909
  Gene Symbol: ST5
  Gene Name: suppression of tumorigenicity 5
  ENSP ID: ENSP00000436748

SEQ ID NO: 85048 - protein, 72 aa, Homo sapiens
  Payload ID: 16909
  Gene Symbol: ST5
  Gene Name: suppression of tumorigenicity 5
  ENSP ID: ENSP00000436760
MTMTANKNSSITHGAGGTKAPRGTLSRKSFEFEDASSLQSLYPSSPTENGTENQPKFGSKSTLEENAYEDIV

SEQ ID NO: 85049 - protein, 717 aa, Homo sapiens; identical to SEQ ID NO: 85038
  Payload ID: 16909
  Gene Symbol: ST5
  Gene Name: suppression of tumorigenicity 5
  Uniprot ID: P78524
  ENSP ID: ENSP00000436802

SEQ ID NO: 85050 - protein, 650 aa, Homo sapiens
  Payload ID: 16909
  Gene Symbol: ST5
  Gene Name: suppression of tumorigenicity 5
  ENSP ID: ENSP00000436808
MPTLQRDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 85051 - protein, 47 aa, Homo sapiens
  Payload ID: 16909
  Gene Symbol: ST5
  Gene Name: suppression of tumorigenicity 5
  ENSP ID: ENSP00000437006
MWSPQDRKYNSPPTQLSLKPNSQSLRSGNWSERKSHRLPRLPKRHSH

SEQ ID NO: 85052 - protein, 217 aa, Homo sapiens
  Payload ID: 16909
  Gene Symbol: ST5
  Gene Name: suppression of tumorigenicity 5
  ENSP ID: ENSP00000437096
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYS

SEQ ID NO: 85053 - protein, 356 aa, Homo sapiens; identical to SEQ ID NO: 85031
  Payload ID: 16909
  Gene Symbol: ST5
  Gene Name: suppression of tumorigenicity 5
  ENSP ID: ENSP00000486899

SEQ ID NO: 85054 - protein, 585 aa, Homo sapiens
  Payload ID: 16910
  Gene Symbol: ST7
  Gene Name: suppression of tumorigenicity 7
  Uniprot ID: Q9NRC1
  ENSP ID: ENSP00000265437
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAMIDIFCSAEFRDWNCKSIFMRVEDELEIPPAPQSQHFQN

SEQ ID NO: 85055 - protein, 577 aa, Homo sapiens
  Payload ID: 16910
  Gene Symbol: ST7
  Gene Name: suppression of tumorigenicity 7
  ENSP ID: ENSP00000325673
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85056 - protein, 499 aa, Homo sapiens
  Payload ID: 16910
  Gene Symbol: ST7
  Gene Name: suppression of tumorigenicity 7
  Uniprot ID: Q9NRC1
  ENSP ID: ENSP00000377089
MSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHSFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85057 - protein, 511 aa, Homo sapiens
  Payload ID: 16910
  Gene Symbol: ST7
  Gene Name: suppression of tumorigenicity 7
  ENSP ID: ENSP00000377090
MFGTESSLSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85058 - protein, 523 aa, Homo sapiens
  Payload ID: 16910
  Gene Symbol: ST7
  Gene Name: suppression of tumorigenicity 7
  ENSP ID: ENSP00000377092
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFHEVSVYPKKELPFFILFTAGLCSFTAMLALLTHQFPELMGVFAKAFLSTLFAPLNFVMEKVESILPSSLWHQLTRI

SEQ ID NO: 85059 - protein, 534 aa, Homo sapiens
  Payload ID: 16910
  Gene Symbol: ST7
  Gene Name: suppression of tumorigenicity 7
  ENSP ID: ENSP00000377093
MFGTESSLSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85060 - protein, 572 aa, Homo sapiens
  Payload ID: 16910
  Gene Symbol: ST7
  Gene Name: suppression of tumorigenicity 7
  ENSP ID: ENSP00000377095
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHSFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85061 - protein, 554 aa, Homo sapiens
  Payload ID: 16910
  Gene Symbol: ST7
  Gene Name: suppression of tumorigenicity 7
  Uniprot ID: Q9NRC1
  ENSP ID: ENSP00000377097
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85062 - protein, 138 aa, Homo sapiens
  Payload ID: 16910
  Gene Symbol: ST7
  Gene Name: suppression of tumorigenicity 7
  ENSP ID: ENSP00000388698
MFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIM

SEQ ID NO: 85063 - protein, 52 aa, Homo sapiens
  Payload ID: 16910
  Gene Symbol: ST7
  Gene Name: suppression of tumorigenicity 7
  ENSP ID: ENSP00000390830
MAEAATGFLEQLKSCIVWSWTYLWTVWFFIVLFLVYILRVPLKINDNLSTDI

SEQ ID NO: 85064 - protein, 62 aa, Homo sapiens
  Payload ID: 16910
  Gene Symbol: ST7
  Gene Name: suppression of tumorigenicity 7
  ENSP ID: ENSP00000391444
MSMFLNTLTPKFYVALTGTSSLISGLILIFEWWYFRKYGTSFIEQVSVSHLRPLLGGVDNNS

SEQ ID NO: 85065 - protein, 64 aa, Homo sapiens
  Payload ID: 16910
  Gene Symbol: ST7
  Gene Name: suppression of tumorigenicity 7
  ENSP ID: ENSP00000392876
MAEAATGFLEQLKSCIVWSWTYLWTVWFFIVLFLVYILRVPLKINDNLSTVNEGVPPSEYVQYP

SEQ ID NO: 85066 - protein, 24 aa, Homo sapiens
  Payload ID: 16910
  Gene Symbol: ST7
  Gene Name: suppression of tumorigenicity 7
  ENSP ID: ENSP00000393040
MFLNTLTPKFYVALTGTSSLISGL

SEQ ID NO: 85067 - protein, 558 aa, Homo sapiens
  Payload ID: 16910
  Gene Symbol: ST7
  Gene Name: suppression of tumorigenicity 7
  ENSP ID: ENSP00000402934
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGIPQHFVCPLKLCHGESGEHPPIQSVAPANTDLREALSSTHLTRRCHHLLCANSLWTARKHDFEKGKPFRDFKMFMDYSILKAVFVVQNSLMFSSILFCLQKRRKSKIKLLCIT

SEQ ID NO: 85068 - protein, 531 aa, Homo sapiens
  Payload ID: 16910
  Gene Symbol: ST7
  Gene Name: suppression of tumorigenicity 7
  ENSP ID: ENSP00000411118
MDYTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85069 - protein, 87 aa, Homo sapiens
  Payload ID: 16910
  Gene Symbol: ST7
  Gene Name: suppression of tumorigenicity 7
  ENSP ID: ENSP00000413601
MSMFLNTLTPKFYVALTGTSSLISGLILIFEWWYFRKYGTSFIEQVSVSHLRPLLGGVDNNSSNNSNSSNGDSDSNRQSVSECKVWR

SEQ ID NO: 85070 - protein, 508 aa, Homo sapiens
  Payload ID: 16910
  Gene Symbol: ST7
  Gene Name: suppression of tumorigenicity 7
  ENSP ID: ENSP00000414031
MDYTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 85071 - protein, 79 aa, Homo sapiens
  Payload ID: 16910
  Gene Symbol: ST7
  Gene Name: suppression of tumorigenicity 7
  ENSP ID: ENSP00000416858
MFLNTLTPKFYVALTGTSSLISGLILIFEWWYFRKYGTSFIEQVSVSHLRPLLGGVDNNSSNNSNSSNGDSDSNRQSVS

SEQ ID NO: 85072 - protein, 561 aa, Homo sapiens
  Payload ID: 16910
  Gene Symbol: ST7
  Gene Name: suppression of tumorigenicity 7
  ENSP ID: ENSP00000419516
MFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPFPQHFVCPLKLCHGESGEHPPIQSVAPANTDLREALSSTHLTRRCHHLLCANSLWTARKHDFEKGKPFRDFKMFMDYSILKAVFVVQNSLMFSSILFCLQKRRKSKIKLLCITA

SEQ ID NO: 85073 - protein, 97 aa, Homo sapiens
  Payload ID: 16910
  Gene Symbol: ST7
  Gene Name: suppression of tumorigenicity 7
  ENSP ID: ENSP00000419715
MFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYN

SEQ ID NO: 85074 - protein, 251 aa, Homo sapiens
  Payload ID: 16910
  Gene Symbol: ST7
  Gene Name: suppression of tumorigenicity 7
  ENSP ID: ENSP00000420052
MFGTESSLSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHSKVSCRLMHWGIRIVKIINQSKFLVQFKI

SEQ ID NO: 85075 - protein, 555 aa, Homo sapiens
  Payload ID: 16911
  Gene Symbol: ST7L
  Gene Name: suppression of tumorigenicity 7 like
  Uniprot ID: Q8TDW4
  ENSP ID: ENSP00000345312
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVSMISRTCVDYL

SEQ ID NO: 85076 - protein, 575 aa, Homo sapiens
  Payload ID: 16911
  Gene Symbol: ST7L
  Gene Name: suppression of tumorigenicity 7 like
  Uniprot ID: Q8TDW4
  ENSP ID: ENSP00000350734
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 85077 - protein, 544 aa, Homo sapiens
  Payload ID: 16911
  Gene Symbol: ST7L
  Gene Name: suppression of tumorigenicity 7 like
  Uniprot ID: Q8TDW4
  ENSP ID: ENSP00000353972
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFHHVSVYPKKELPLFIHFTAGFCSSTAMIAILTHQFPEIMGIFAKAVLGLWCPQPWASSGFEENTQDLKSEDLGLSSG

SEQ ID NO: 85078 - protein, 229 aa, Homo sapiens
  Payload ID: 16911
  Gene Symbol: ST7L
  Gene Name: suppression of tumorigenicity 7 like
  ENSP ID: ENSP00000358678
MSPFLFRDDMKDLTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQL

SEQ ID NO: 85079 - protein, 538 aa, Homo sapiens
  Payload ID: 16911
  Gene Symbol: ST7L
  Gene Name: suppression of tumorigenicity 7 like
  Uniprot ID: Q8TDW4
  ENSP ID: ENSP00000358680
MADRGGVGEAAAVGASPASVPGLNPTLGWRERLRAGLAGTGASLWFVAGLGLLYALRIPLRLCENLAAGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVSMISRTCVDYL

SEQ ID NO: 85080 - protein, 392 aa, Homo sapiens
  Payload ID: 16911
  Gene Symbol: ST7L
  Gene Name: suppression of tumorigenicity 7 like
  Uniprot ID: Q8TDW4
  ENSP ID: ENSP00000358683
MNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 85081 - protein, 287 aa, Homo sapiens
  Payload ID: 16911
  Gene Symbol: ST7L
  Gene Name: suppression of tumorigenicity 7 like
  ENSP ID: ENSP00000413718
  MOD_RES (1)..(1): Any amino acid
XISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDYLLEMKSLILPPEHILKRGDSEAIAYAFFHLQHWKRIEGALNLLQCTWEGTFHHVSVYPKKELPLFIHFTAGFCSSTAMIAILTHQFPEIMGIFAKA

SEQ ID NO: 85082 - protein, 558 aa, Homo sapiens
  Payload ID: 16911
  Gene Symbol: ST7L
  Gene Name: suppression of tumorigenicity 7 like
  Uniprot ID: Q8TDW4
  ENSP ID: ENSP00000417140
MADRGGVGEAAAVGASPASVPGLNPTLGWRERLRAGLAGTGASLWFVAGLGLLYALRIPLRLCENLAAGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 85083 - protein, 555 aa, Homo sapiens
  Payload ID: 16911
  Gene Symbol: ST7L
  Gene Name: suppression of tumorigenicity 7 like
  Uniprot ID: Q8TDW4
  ENSP ID: ENSP00000436499
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVVGVKTQKENAD

SEQ ID NO: 85084 - protein, 555 aa, Homo sapiens; identical to SEQ ID NO: 85083
  Payload ID: 16911
  Gene Symbol: ST7L
  Gene Name: suppression of tumorigenicity 7 like
  Uniprot ID: Q8TDW4
  ENSP ID: ENSP00000436544

SEQ ID NO: 85085 - protein, 147 aa, Homo sapiens
  Payload ID: 16912
  Gene Symbol: SAPCD1
  Gene Name: suppressor APC domain containing 1
  ENSP ID: ENSP00000372692
MGSQGSGGVPLVQAPYTVLLLPLGTSRQDPGAQSFFLWLRRMQALEREQDALWQGLELLQHGQAWFEDHLREAQRQQLHLGALGENFLTDLHSEPGRPPLAQIQKVNICLQNLIHEKLSRQQKGVTQPKEEMAQRGCTKGPRGPTRV

SEQ ID NO: 85086 - protein, 178 aa, Homo sapiens
  Payload ID: 16912
  Gene Symbol: SAPCD1
  Gene Name: suppressor APC domain containing 1
  Uniprot ID: Q5SSQ6
  ENSP ID: ENSP00000387942
MGSQGSGGVPLVQAPYTVLLLPLGTSRQDPGAQSFFLWLRRMQALEREQDALWQGLELLQHGQAWFEDHLREAQRQQLHLGALGENFLTDLHSEPGRPPLAQIQKVNICLQNLIHEKFSPSPLNKASSCTTQDSKERRREQNLWQQQELSRQQKGVTQPKEEMAQRGCTKGPRGPTRV

SEQ ID NO: 85087 - protein, 178 aa, Homo sapiens; identical to SEQ ID NO: 85086
  Payload ID: 16912
  Gene Symbol: SAPCD1
  Gene Name: suppressor APC domain containing 1
  Uniprot ID: Q5SSQ6
  ENSP ID: ENSP00000403346

SEQ ID NO: 85088 - protein, 178 aa, Homo sapiens; identical to SEQ ID NO: 85086
  Payload ID: 16912
  Gene Symbol: SAPCD1
  Gene Name: suppressor APC domain containing 1
  Uniprot ID: Q5SSQ6
  ENSP ID: ENSP00000403687

SEQ ID NO: 85089 - protein, 178 aa, Homo sapiens; identical to SEQ ID NO: 85086
  Payload ID: 16912
  Gene Symbol: SAPCD1
  Gene Name: suppressor APC domain containing 1
  Uniprot ID: Q5SSQ6
  ENSP ID: ENSP00000404105

SEQ ID NO: 85090 - protein, 178 aa, Homo sapiens; identical to SEQ ID NO: 85086
  Payload ID: 16912
  Gene Symbol: SAPCD1
  Gene Name: suppressor APC domain containing 1
  Uniprot ID: Q5SSQ6
  ENSP ID: ENSP00000405513

SEQ ID NO: 85091 - protein, 117 aa, Homo sapiens
  Payload ID: 16912
  Gene Symbol: SAPCD1
  Gene Name: suppressor APC domain containing 1
  ENSP ID: ENSP00000408918
MGSQGSGGVPLVQAPYTVLLLPLGTSRQDPGAQSFFLWLRRMQALEREQDALWQGLELLQHGQAWFEDHLREAQRQQLHLGALGENFLTDLHSEPGRPPLAQIQKVNICLQNLIHEK

SEQ ID NO: 85092 - protein, 147 aa, Homo sapiens; identical to SEQ ID NO: 85085
  Payload ID: 16912
  Gene Symbol: SAPCD1
  Gene Name: suppressor APC domain containing 1
  ENSP ID: ENSP00000410585

SEQ ID NO: 85093 - protein, 178 aa, Homo sapiens; identical to SEQ ID NO: 85086
  Payload ID: 16912
  Gene Symbol: SAPCD1
  Gene Name: suppressor APC domain containing 1
  Uniprot ID: Q5SSQ6
  ENSP ID: ENSP00000411948

SEQ ID NO: 85094 - protein, 147 aa, Homo sapiens; identical to SEQ ID NO: 85085
  Payload ID: 16912
  Gene Symbol: SAPCD1
  Gene Name: suppressor APC domain containing 1
  ENSP ID: ENSP00000412154

SEQ ID NO: 85095 - protein, 148 aa, Homo sapiens; identical to SEQ ID NO: 53046
  Payload ID: 16912
  Gene Symbol: SAPCD1
  Gene Name: suppressor APC domain containing 1
  Uniprot ID: Q5SSQ6
  ENSP ID: ENSP00000413372

SEQ ID NO: 85096 - protein, 147 aa, Homo sapiens; identical to SEQ ID NO: 85085
  Payload ID: 16912
  Gene Symbol: SAPCD1
  Gene Name: suppressor APC domain containing 1
  ENSP ID: ENSP00000414539

SEQ ID NO: 85097 - protein, 147 aa, Homo sapiens; identical to SEQ ID NO: 85085
  Payload ID: 16912
  Gene Symbol: SAPCD1
  Gene Name: suppressor APC domain containing 1
  ENSP ID: ENSP00000414654

SEQ ID NO: 85098 - protein, 148 aa, Homo sapiens; identical to SEQ ID NO: 53046
  Payload ID: 16912
  Gene Symbol: SAPCD1
  Gene Name: suppressor APC domain containing 1
  Uniprot ID: Q5SSQ6
  ENSP ID: ENSP00000450257

SEQ ID NO: 85099 - protein, 394 aa, Homo sapiens
  Payload ID: 16913
  Gene Symbol: SAPCD2
  Gene Name: suppressor APC domain containing 2
  Uniprot ID: Q86UD0
  ENSP ID: ENSP00000386348
MAGAAMAERGRVPPPAPAPSTEGLPRAFLQSLRTLFDILDDRRRGCVHLREIESRWQGTDARELPRGVLEGLRQVAPASGYLTFERFVAGLRTSLLSADGGPRDPTRAPARPGDQPPPPPQRLVFAPADEPRTVLERKPLPLGVRAPLAGPSAAARSPEQLCAPAEAAPCPAEPERSQSAALEPSSSADAGAVACRALEADSGDARRAPRARGERRRHTIASGVDCGLLKQMKELEQEKEVLLQGLEMMARGRDWYQQQLQRVQERQRRLGQSRASADFGAAGSPRPLGRLLPKVQEVARCLGELLAAACASRALPPSSSGPPCPALTSTSPPVWQQQTILMLKEQNRLLTQEVTEKSERITQLEQEKSALIKQLFEARALSQQDGGPLDSTFI

SEQ ID NO: 85100 - protein, 606 aa, Homo sapiens
  Payload ID: 16914
  Gene Symbol: SCAI
  Gene Name: suppressor of cancer cell invasion
  Uniprot ID: Q8N9R8
  ENSP ID: ENSP00000336756
MVRGARQPQQPRSRLAPRLTGTVEKPPRKRRSRTEFALKEIMSSGGAEDDIPQGERKTVTDFCYLLDKSKQLFNGLRDLPQYGQKQWQSYFGRTFDVYTKLWKFQQQHRQVLDNRYGLKRWQIGEIASKIGQLYYHYYLRTSETSYLNEAFSFYSAIRQRSYYSQVNKEDRPELVVKKLRYYARFIVVCLLLNKMDVVKDLVKELSDEIEDYTHRFNTEDQVEWNLVLQEVAAFIEADPVMVLNDDNTIVITSNRLAETGAPLLEQGMIVGQLSLADALIIGNCNNQVKFSELTVDMFRMLQALEREPMNLASQMNKPGMQESADKPTRRENPHKYLLYKPTFSQLYTFLAASFKELPANSVLLIYLSATGVFPTGRSDSEGPYDFGGVLTNSNRDIINGDAIHKRNQSHKEMHCLHPGDLYPFTRKPLFIIVDSSNSVAYKNFTNLFGQPLVCLLSPTAYPKALQDQSQRGSLFTLFLNNPLMAFLFVSGLSSMRRGLWEKCQEYLRKINRDIAQLLTHSRSIDQAFLQFFGDEFLRLLLTRFIFCSATMRMHKIFRETRNYPESYPQLPRDETVENPHLQKHILELASILDVRNVFFENTIDDY

SEQ ID NO: 85101 - protein, 629 aa, Homo sapiens
  Payload ID: 16914
  Gene Symbol: SCAI
  Gene Name: suppressor of cancer cell invasion
  Uniprot ID: Q8N9R8
  ENSP ID: ENSP00000362650
MVRGARQPQQPRSRLAPRLTGTVEKPPRKRRSSIRGSGDSSHSQSQGERYQHFTEKTEFALKEIMSSGGAEDDIPQGERKTVTDFCYLLDKSKQLFNGLRDLPQYGQKQWQSYFGRTFDVYTKLWKFQQQHRQVLDNRYGLKRWQIGEIASKIGQLYYHYYLRTSETSYLNEAFSFYSAIRQRSYYSQVNKEDRPELVVKKLRYYARFIVVCLLLNKMDVVKDLVKELSDEIEDYTHRFNTEDQVEWNLVLQEVAAFIEADPVMVLNDDNTIVITSNRLAETGAPLLEQGMIVGQLSLADALIIGNCNNQVKFSELTVDMFRMLQALEREPMNLASQMNKPGMQESADKPTRRENPHKYLLYKPTFSQLYTFLAASFKELPANSVLLIYLSATGVFPTGRSDSEGPYDFGGVLTNSNRDIINGDAIHKRNQSHKEMHCLHPGDLYPFTRKPLFIIVDSSNSVAYKNFTNLFGQPLVCLLSPTAYPKALQDQSQRGSLFTLFLNNPLMAFLFVSGLSSMRRGLWEKCQEYLRKINRDIAQLLTHSRSIDQAFLQFFGDEFLRLLLTRFIFCSATMRMHKIFRETRNYPESYPQLPRDETVENPHLQKHILELASILDVRNVFFENTIDDY

SEQ ID NO: 85102 - protein, 88 aa, Homo sapiens
  Payload ID: 16914
  Gene Symbol: SCAI
  Gene Name: suppressor of cancer cell invasion
  ENSP ID: ENSP00000418148
  MOD_RES (1)..(1): Any amino acid
XKRNQSHKEMHCLHPGDLYPFTRKPLFIIVDSSNSVAYKNFTNLFGQPLVCLLSPTAYPKALQVLMSLCGRWHFTATSQPEVLSADIV

SEQ ID NO: 85103 - protein, 32 aa, Homo sapiens
  Payload ID: 16914
  Gene Symbol: SCAI
  Gene Name: suppressor of cancer cell invasion
  ENSP ID: ENSP00000419358
NFTNLFGQPLVCLLSPTAYPKALQGTGSHHVA

SEQ ID NO: 85104 - protein, 490 aa, Homo sapiens
  Payload ID: 16914
  Gene Symbol: SCAI
  Gene Name: suppressor of cancer cell invasion
  ENSP ID: ENSP00000419576
MVRGARQPQQPRSRLAPRLTGTVEKPPRKRRSRTEFALKEIMSSGGAEDDIPQGERKTVTDFCYLLDKSKQLFNGLRDLPQYGQKQWQSYFGRTFDVYTKLWKFQQQHRQVLDNRYGLKRWQIGEIASKIGQLYYHYYLRTSETSYLNEAFSFYSAIRQRSYYSQVNKEDRPELVVKKLRYYARFIVVCLLLNKMDVVKDLVKELSDEIEDYTHRFNTEDQVEWNLVLQEVAAFIEADPVMVLNDDNTIVITSNRLAETGAPLLEQGMIVGQLSLADALIIGNCNNQVKFSELTVDMFRMLQALEREPMNLASQMNKPGMQESADKPTRRENPHKYLLYKPTFSQLYTFLAASFKELPANSVLLIYLSATGVFPTGRSDSEGPYDFGGVLTNSNRDIINGDAIHKRNQSHKEMHCLHPGDLYPFTRKPLFIIVDSSNSVAYKNFTNLFGQPLVCLLSPTAYPKALQACAEAYGKSVKNIFEKSTVILPSY

SEQ ID NO: 85105 - protein, 211 aa, Homo sapiens
  Payload ID: 16915
  Gene Symbol: SOCS1
  Gene Name: suppressor of cytokine signaling 1
  Uniprot ID: O15524
  ENSP ID: ENSP00000329418
MVAHNQVAADNAVSTAAEPRRRPEPSSSSSSSPAAPARPRPCPAVPAPAPGDTHFRTFRSHADYRRITRASALLDACGFYWGPLSVHGAHERLRAEPVGTFLVRDSRQRNCFFALSVKMASGPTSIRVHFQAGRFHLDGSRESFDCLFELLEHYVAAPRRMLGAPLRQRRVRPLQELCRQRIVATVGRENLARIPLNPVLRDYLSSFPFQI

SEQ ID NO: 85106 - protein, 198 aa, Homo sapiens
  Payload ID: 16916
  Gene Symbol: SOCS2
  Gene Name: suppressor of cytokine signaling 2
  Uniprot ID: O14508
  ENSP ID: ENSP00000339428
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAPSLQHLCRLTINKCTGAIWGLPLPTRLKDYLEEYKFQV

SEQ ID NO: 85107 - protein, 198 aa, Homo sapiens; identical to SEQ ID NO: 85106
  Payload ID: 16916
  Gene Symbol: SOCS2
  Gene Name: suppressor of cytokine signaling 2
  Uniprot ID: O14508
  ENSP ID: ENSP00000442898

SEQ ID NO: 85108 - protein, 198 aa, Homo sapiens; identical to SEQ ID NO: 85106
  Payload ID: 16916
  Gene Symbol: SOCS2
  Gene Name: suppressor of cytokine signaling 2
  Uniprot ID: O14508
  ENSP ID: ENSP00000447161

SEQ ID NO: 85109 - protein, 142 aa, Homo sapiens
  Payload ID: 16916
  Gene Symbol: SOCS2
  Gene Name: suppressor of cytokine signaling 2
  ENSP ID: ENSP00000447902
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEA

SEQ ID NO: 85110 - protein, 161 aa, Homo sapiens
  Payload ID: 16916
  Gene Symbol: SOCS2
  Gene Name: suppressor of cytokine signaling 2
  ENSP ID: ENSP00000448611
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAP

SEQ ID NO: 85111 - protein, 102 aa, Homo sapiens
  Payload ID: 16916
  Gene Symbol: SOCS2
  Gene Name: suppressor of cytokine signaling 2
  ENSP ID: ENSP00000448709
MTLRCLEPSGNGGEGTRSQWGTAGSAEEPSPQAARLAKALRELGQTGREPIGRDACGRERLPKEAARKRGRGGKQRIRWKYVPCFQGTAESTLAGSWVLGNA

SEQ ID NO: 85112 - protein, 198 aa, Homo sapiens; identical to SEQ ID NO: 85106
  Payload ID: 16916
  Gene Symbol: SOCS2
  Gene Name: suppressor of cytokine signaling 2
  Uniprot ID: O14508
  ENSP ID: ENSP00000448815

SEQ ID NO: 85113 - protein, 198 aa, Homo sapiens; identical to SEQ ID NO: 85106
  Payload ID: 16916
  Gene Symbol: SOCS2
  Gene Name: suppressor of cytokine signaling 2
  Uniprot ID: O14508
  ENSP ID: ENSP00000449227

SEQ ID NO: 85114 - protein, 2 aa, Homo sapiens
  Payload ID: 16916
  Gene Symbol: SOCS2
  Gene Name: suppressor of cytokine signaling 2
  ENSP ID: ENSP00000473902
MT

SEQ ID NO: 85115 - protein, 116 aa, Homo sapiens
  Payload ID: 16916
  Gene Symbol: SOCS2
  Gene Name: suppressor of cytokine signaling 2
  ENSP ID: ENSP00000474805
  MOD_RES (1)..(1): Any amino acid
XYVQMCKDKRTGPEAPRNGTVHLYLTKPLYTSAPSLQHLCRLTINKCTGAIWGLPLPTRLKDYLEEYKFQVQAPVGEKELLIGILKKWEGTKLTQASLQFDMPADQSLLGILYFAF

SEQ ID NO: 85116 - protein, 46 aa, Homo sapiens
  Payload ID: 16916
  Gene Symbol: SOCS2
  Gene Name: suppressor of cytokine signaling 2
  ENSP ID: ENSP00000474888
  MOD_RES (1)..(1): Any amino acid
XAPSLQHLCRLTINKCTGAIWGLPLPTRLKDYLEEYKFQPAVFYPG

SEQ ID NO: 85117 - protein, 198 aa, Homo sapiens; identical to SEQ ID NO: 85106
  Payload ID: 16916
  Gene Symbol: SOCS2
  Gene Name: suppressor of cytokine signaling 2
  Uniprot ID: O14508
  ENSP ID: ENSP00000481249

SEQ ID NO: 85118 - protein, 225 aa, Homo sapiens
  Payload ID: 16917
  Gene Symbol: SOCS3
  Gene Name: suppressor of cytokine signaling 3
  Uniprot ID: O14543
  ENSP ID: ENSP00000330341
MVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYMPPPGAPSFPSPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 85119 - protein, 15 aa, Homo sapiens
  Payload ID: 16917
  Gene Symbol: SOCS3
  Gene Name: suppressor of cytokine signaling 3
  ENSP ID: ENSP00000464727
MVTHSKFPAAGMSRP

SEQ ID NO: 85120 - protein, 440 aa, Homo sapiens
  Payload ID: 16918
  Gene Symbol: SOCS4
  Gene Name: suppressor of cytokine signaling 4
  Uniprot ID: Q8WXH5
  ENSP ID: ENSP00000341327
MAENNENISKNVDVRPKTSRSRSADRKDGYVWSGKKLSWSKKSESYSDAETVNGIEKTEVSLRNQERKHSCSSIELDLDHSCGHRFLGRSLKQKLQDAVGQCFPIKNCSSRHSSGLPSKRKIHISELMLDKCPFPPRSDLAFRWHFIKRHTAPINSKSDEWVSTDLSQTELRDGQLKRRNMEENINCFSHTNVQPCVITTDNALCREGPMTGSVMNLVSNNSIEDSDMDSDDEILTLCTSSRKRNKPKWDLDDEILQLETPPKYHTQIDYVHCLVPDLLQINNNPCYWGVMDKYAAEALLEGKPEGTFLLRDSAQEDYLFSVSFRRYSRSLHARIEQWNHNFSFDAHDPCVFHSPDITGLLEHYKDPSACMFFEPLLSTPLIRTFPFSLQHICRTVICNCTTYDGIDALPIPSSMKLYLKEYHYKSKVRVLRIDAPEQQC

SEQ ID NO: 85121 - protein, 440 aa, Homo sapiens; identical to SEQ ID NO: 85120
  Payload ID: 16918
  Gene Symbol: SOCS4
  Gene Name: suppressor of cytokine signaling 4
  Uniprot ID: Q8WXH5
  ENSP ID: ENSP00000378855

SEQ ID NO: 85122 - protein, 440 aa, Homo sapiens; identical to SEQ ID NO: 85120
  Payload ID: 16918
  Gene Symbol: SOCS4
  Gene Name: suppressor of cytokine signaling 4
  Uniprot ID: Q8WXH5
  ENSP ID: ENSP00000452522

SEQ ID NO: 85123 - protein, 536 aa, Homo sapiens
  Payload ID: 16919
  Gene Symbol: SOCS5
  Gene Name: suppressor of cytokine signaling 5
  Uniprot ID: O75159
  ENSP ID: ENSP00000305133
MDKVGKMWNNFKYRCQNLFGHEGGSRSENVDMNSNRCLSVKEKNISIGDSTPQQQSSPLRENIALQLGLSPSKNSSRRNQNCATEIPQIVEISIEKDNDSCVTPGTRLARRDSYSRHAPWGGKKKHSCSTKTQSSLDADKKFGRTRSGLQRRERRYGVSSVHDMDSVSSRTVGSRSLRQRLQDTVGLCFPMRTYSKQSKPLFSNKRKIHLSELMLEKCPFPAGSDLAQKWHLIKQHTAPVSPHSTFFDTFDPSLVSTEDEEDRLRERRRLSIEEGVDPPPNAQIHTFEATAQVNPLYKLGPKLAPGMTEISGDSSAIPQANCDSEEDTTTLCLQSRRQKQRQISGDSHTHVSRQGAWKVHTQIDYIHCLVPDLLQITGNPCYWGVMDRYEAEALLEGKPEGTFLLRDSAQEDYLFSVSFRRYNRSLHARIEQWNHNFSFDAHDPCVFHSSTVTGLLEHYKDPSSCMFFEPLLTISLNRTFPFSLQYICRAVICRCTTYDGIDGLPLPSMLQDFLKEYHYKQKVRVRWLEREPVKAK

SEQ ID NO: 85124 - protein, 536 aa, Homo sapiens; identical to SEQ ID NO: 85123
  Payload ID: 16919
  Gene Symbol: SOCS5
  Gene Name: suppressor of cytokine signaling 5
  Uniprot ID: O75159
  ENSP ID: ENSP00000378330

SEQ ID NO: 85125 - protein, 535 aa, Homo sapiens
  Payload ID: 16920
  Gene Symbol: SOCS6
  Gene Name: suppressor of cytokine signaling 6
  Uniprot ID: O14544
  ENSP ID: ENSP00000381034
MKKISLKTLRKSFNLNKSKEETDFMVVQQPSLASDFGKDDSLFGSCYGKDMASCDINGEDEKGGKNRSKSESLMGTLKRRLSAKQKSKGKAGTPSGSSADEDTFSSSSAPIVFKDVRAQRPIRSTSLRSHHYSPAPWPLRPTNSEETCIKMEVRVKALVHSSSPSPALNGVRKDFHDLQSETTCQEQANSLKSSASHNGDLHLHLDEHVPVVIGLMPQDYIQYTVPLDEGMYPLEGSRSYCLDSSSPMEVSAVPPQVGGRAFPEDESQVDQDLVVAPEIFVDQSVNGLLIGTTGVMLQSPRAGHDDVPPLSPLLPPMQNNQIQRNFSGLTGTEAHVAESMRCHLNFDPNSAPGVARVYDSVQSSGPMVVTSLTEELKKLAKQGWYWGPITRWEAEGKLANVPDGSFLVRDSSDDRYLLSLSFRSHGKTLHTRIEHSNGRFSFYEQPDVEGHTSIVDLIEHSIRDSENGAFCYSRSRLPGSATYPVRLTNPVSRFMQVRSLQYLCRFVIRQYTRIDLIQKLPLPNKMKDYLQEKHY

SEQ ID NO: 85126 - protein, 227 aa, Homo sapiens
  Payload ID: 16920
  Gene Symbol: SOCS6
  Gene Name: suppressor of cytokine signaling 6
  ENSP ID: ENSP00000463064
MKKISLKTLRKSFNLNKSKEETDFMVVQQPSLASDFGKDDSLFGSCYGKDMASCDINGEDEKGGKNRSKSESLMGTLKRRLSAKQKSKGKAGTPSGSSADEDTFSSSSAPIVFKDVRAQRPIRSTSLRSHHYSPAPWPLRPTNSEETCIKMEVRVKALVHSSSPSPALNGVRKDFHDLQSETTCQEQANSLKSSASHNGDLHLHLDEHVPVVIGLMPQDYIQYTVPL

SEQ ID NO: 85127 - protein, 535 aa, Homo sapiens; identical to SEQ ID NO: 85125
  Payload ID: 16920
  Gene Symbol: SOCS6
  Gene Name: suppressor of cytokine signaling 6
  Uniprot ID: O14544
  ENSP ID: ENSP00000463395

SEQ ID NO: 85128 - protein, 581 aa, Homo sapiens
  Payload ID: 16921
  Gene Symbol: SOCS7
  Gene Name: suppressor of cytokine signaling 7
  Uniprot ID: O14512
  ENSP ID: ENSP00000480736
MVFRNVGRPPEEEDVEAAPEPGPSELLCPRHRCALDPKALPPGLALERTWGPAAGLEAQLAALGLGQPAGPGVKTVGGGCCPCPCPPQPPPPQPQPPAAAPQAGEDPTETSDALLVLEGLESEAESLETNSCSEEELSSPGRGGGGGGRLLLQPPGPELPPVPFPLQDLVPLGRLSRGEQQQQQQQQPPPPPPPPGPLRPLAGPSRKGSFKIRLSRLFRTKSCNGGSGGGDGTGKRPSGELAASAASLTDMGGSAGRELDAGRKPKLTRTQSAFSPVSFSPLFTGETVSLVDVDISQRGLTSPHPPTPPPPPRRSLSLLDDISGTLPTSVLVAPMGSSLQSFPLPPPPPPHAPDAFPRIAPIRAAESLHSQPPQHLQCPLYRPDSSSFAASLRELEKCGWYWGPMNWEDAEMKLKGKPDGSFLVRDSSDPRYILSLSFRSQGITHHTRMEHYRGTFSLWCHPKFEDRCQSVVEFIKRAIMHSKNGKFLYFLRSRVPGLPPTPVQLLYPVSRFSNVKSLQHLCRFRIRQLVRIDHIPDLPLPKPLISYIRKFYYYDPQEEVYLSLKEAQLISKQKQEVEPST

SEQ ID NO: 85129 - protein, 581 aa, Homo sapiens; identical to SEQ ID NO: 85128
  Payload ID: 16921
  Gene Symbol: SOCS7
  Gene Name: suppressor of cytokine signaling 7
  Uniprot ID: O14512
  ENSP ID: ENSP00000482229

SEQ ID NO: 85130 - protein, 160 aa, Homo sapiens
  Payload ID: 16921
  Gene Symbol: SOCS7
  Gene Name: suppressor of cytokine signaling 7
  ENSP ID: ENSP00000482278
  MOD_RES (1)..(1): Any amino acid
XGKRPSGELAASAASLTDMGGSAGRELDAGRKPKLTRTQSAFSPVSFSPLFTDAFPRIAPIRAAESLHSQPPQHLQCPLYRPDSSSFAASLRELEKCGWYWGPMNWEDAEMKLKGKPDGSFLVRDSSDPRYILSLSFRSQGITHHTRMEHYRGTFSLWCH

SEQ ID NO: 85131 - protein, 547 aa, Homo sapiens
  Payload ID: 16921
  Gene Symbol: SOCS7
  Gene Name: suppressor of cytokine signaling 7
  ENSP ID: ENSP00000484381
MVFRNVGRPPEEEDVEAAPEPGPSELLCPRHRCALDPKALPPGLALERTWGPAAGLEAQLAALGLGQPAGPGVKTVGGGCCPCPCPPQPPPPQPQPPAAAPQAGEDPTETSDALLVLEGLESEAESLETNSCSEEELSSPGRGGGGGGRLLLQPPGPELPPVPFPLQDLVPLGRLSRGEQQQQQQQQPPPPPPPPGPLRPLAGPSRKGSFKIRLSRLFRTKSCNGGSGGGDGTGKRPSGELAASAASLTDMGGSAGRELDAGRKPKLTRTQSAFSPVSFSPLFTGETVSLVDVDISQRGLTSPHPPTPPPPPRRSLSLLDAFPRIAPIRAAESLHSQPPQHLQCPLYRPDSSSFAASLRELEKCGWYWGPMNWEDAEMKLKGKPDGSFLVRDSSDPRYILSLSFRSQGITHHTRMEHYRGTFSLWCHPKFEDRCQSVVEFIKRAIMHSKNGKFLYFLRSRVPGLPPTPVQLLYPVSRFSNVKSLQHLCRFRIRQLVRIDHIPDLPLPKPLISYIRKFYYYDPQEEVYLSLKEAQLISKQKQEVEPST

SEQ ID NO: 85132 - protein, 160 aa, Homo sapiens; identical to SEQ ID NO: 85130
  Payload ID: 16921
  Gene Symbol: SOCS7
  Gene Name: suppressor of cytokine signaling 7
  ENSP ID: ENSP00000487855
  MOD_RES (1)..(1): Any amino acid

SEQ ID NO: 85133 - protein, 547 aa, Homo sapiens; identical to SEQ ID NO: 85131
  Payload ID: 16921
  Gene Symbol: SOCS7
  Gene Name: suppressor of cytokine signaling 7
  ENSP ID: ENSP00000488601

SEQ ID NO: 85134 - protein, 433 aa, Homo sapiens
  Payload ID: 16922
  Gene Symbol: SUFU
  Gene Name: suppressor of fused homolog (Drosophila)
  Uniprot ID: Q9UMX1
  ENSP ID: ENSP00000358915
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQL

SEQ ID NO: 85135 - protein, 484 aa, Homo sapiens
  Payload ID: 16922
  Gene Symbol: SUFU
  Gene Name: suppressor of fused homolog (Drosophila)
  Uniprot ID: Q9UMX1
  ENSP ID: ENSP00000358918
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQILLTEEFVEKMLEDLEDLTSPEEFKLPKEYSWPEKKLKVSILPDVVFDSPLH

SEQ ID NO: 85136 - protein, 481 aa, Homo sapiens
  Payload ID: 16922
  Gene Symbol: SUFU
  Gene Name: suppressor of fused homolog (Drosophila)
  Uniprot ID: Q9UMX1
  ENSP ID: ENSP00000411597
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQVRRPFFFSLLPFIDFLAHPSSSPLAALDGTPSWGAGHECLMDSGPGACV

SEQ ID NO: 85137 - protein, 1661 aa, Homo sapiens
  Payload ID: 16923
  Gene Symbol: SOGA1
  Gene Name: suppressor of glucose, autophagy associated 1
  Uniprot ID: O94964
  ENSP ID: ENSP00000237536
MEAPAAEPPVRGCGPQPAPAPAPAPERKKSHRAPSPARPKDVAGWSLAKGRRGPGPGSAVACSAAFSSRPDKKGRAVAPGARGAGVRVAGVRTGVRAKGRPRSGAGPRPPPPPPSLTDSSSEVSDCASEEARLLGLELALSSDAESAAGGPAGVRTGQPAQPAPSAQQPPRPPASPDEPSVAASSVGSSRLPLSASLAFSDLTEEMLDCGPSGLVRELEELRSENDYLKDEIEELRAEMLEMRDVYMEEDVYQLQELRQQLDQASKTCRILQYRLRKAERRSLRAAQTGQVDGELIRGLEQDVKVSKDISMRLHKELEVVEKKRARLEEENEELRQRLIETELAKQVLQTELERPREHSLKKRGTRSLGKADKKTLVQEDSADLKCQLHFAKEESALMCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAELEDQNKLLLNELAKFRSEHELDVALSEDSCSVLSEPSQEELAAAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQLQKAADPWVLKHSELEKQDNSWKETRSEKIHDKEAVSEVELGGNGLKRTKSVSSMSEFESLLDCSPYLAGGDARGKKLPNNPAFGFVSSEPGDPEKDTKEKPGLSSRDCNHLGALACQDPPGRQMQRSYTAPDKTGIRVYYSPPVARRLGVPVVHDKEGKIIIEPGFLFTTAKPKESAEADGLAESSYGRWLCNFSRQRLDGGSAGSPSAAGPGFPAALHDFEMSGNMSDDMKEITNCVRQAMRSGSLERKVKSTSSQTVGLASVGTQTIRTVSVGLQTDPPRSSLHGKAWSPRSSSLVSVRSKQISSSLDKVHSRIERPCCSPKYGSPKLQRRSVSKLDSSKDRSLWNLHQGKQNGSAWARSTTTRDSPVLRNINDGLSSLFSVVEHSGSTESVWKLGMSETRAKPEPPKYGIVQEFFRNVCGRAPSPTSSAGEEGTKKPEPLSPASYHQPEGVARILNKKAAKLGSSEEVRLTMLPQVGKDGVLRDGDGAVVLPNEDAVCDCSTQSLTSCFARSSRSAIRHSPSKCRLHPSESSWGGEERALPPSE

SEQ ID NO: 85138 - protein, 1016 aa, Homo sapiens
  Payload ID: 16923
  Gene Symbol: SOGA1
  Gene Name: suppressor of glucose, autophagy associated 1
  ENSP ID: ENSP00000279034
MLEMRDVYMEEDVYQLQELRQQLDQASKTCRILQYRLRKAERRSLRAAQTGQVDGELIRGLEQDVKVSKDISMRLHKELEVVEKKRARLEEENEELRQRLIETELAKQVLQTELERPREHSLKKRGTRSLGKADKKTLVQEDSADLKCQLHFAKEESALMCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAELEDQNKLLLNELAKFRSEHELDVALSEDSCSVLSEPSQEELAAAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQLQKAADPWVLKHSELEKQDNSWKETRSEKIHDKEAVSEVELGGNGLKRTKSVSSMSEFESLLDCSPYLAGGDARGKKLPNNPAFGFVSSEPGDPEKDTKEKPGLSSRDCNHLGALACQDPPGSQKLPFLLILAPPQPPPIL

SEQ ID NO: 85139 - protein, 1275 aa, Homo sapiens
  Payload ID: 16923
  Gene Symbol: SOGA1
  Gene Name: suppressor of glucose, autophagy associated 1
  ENSP ID: ENSP00000433939
  MOD_RES (1)..(1): Any amino acid
XLHFAKEESALMCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAELEDQNKLLLNELAKFRSEHELDVALSEDSCSVLSEPSQEELAAAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQLQKAADPWVLKHSELEKQDNSWKETRSEKIHDKEAVSEVELGGNGLKRTKSVSSMSEFESLLDCSPYLAGGDARGKKLPNNPAFGFVSSEPGDPEKDTKEKPGLSSRDCNHLGALACQDPPGRQMQRSYTAPDKTGIRVYYSPPVARRLGVPVVHDKEGKIIIEPGFLFTTAKPKESAEADGLAESSYGRWLCNFSRQRLDGGSAGSPSAAGPGFPAALHDFEMSGNMSDDMKEITNCVRQAMRSGSLERKVKSTSSQTVGLASVGTQTIRTVSVGLQTDPPRSSLHGKAWSPRSSSLVSVRSKQISSSLDKVHSRIERPCCSPKYGSPKLQRRSVSKLDSSKDRSLWNLHQGKQNGSAWARSTTTRDSPVLRNINDGLSSLFSVVEHSGSTESVWKLGMSETRAKPEPPKYGIVQEFFRNVCGRAPSPTSSAGEEGTKKPEPLSPASYHQPEGVARILNKKAAKLGSSEEVRLTMLPQVGKDGVLRDGDGAVVLPNEDAVCDCSTQSLTSCFARSSRSAIRHSPSKCRLHPSESSWGGEERALPPSE

SEQ ID NO: 85140 - protein, 207 aa, Homo sapiens
  Payload ID: 16924
  Gene Symbol: SIKE1
  Gene Name: suppressor of IKBKE 1
  Uniprot ID: Q9BRV8
  ENSP ID: ENSP00000060969
MSCTIEKILTDAKTLLERLREHDAAAESLVDQSAALHRRVAAMREAGTALPDQYQEDASDMKDMSKYKPHILLSQENTQIRDLQQENRELWISLEEHQDALELIMSKYRKQMLQLMVAKKAVDAEPVLKAHQSHSAEIESQIDRICEMGEVMRKAVQVDDDQFCKIQEKLAQLELENKELRELLSISSESLQARKENSMDTASQAIK

SEQ ID NO: 85141 - protein, 211 aa, Homo sapiens
  Payload ID: 16924
  Gene Symbol: SIKE1
  Gene Name: suppressor of IKBKE 1
  Uniprot ID: Q9BRV8
  ENSP ID: ENSP00000358541
MSCTIEKILTDAKTLLERLREHDAAAESLVDQSAALHRRVAAMREAGTALPDQVRQRYQEDASDMKDMSKYKPHILLSQENTQIRDLQQENRELWISLEEHQDALELIMSKYRKQMLQLMVAKKAVDAEPVLKAHQSHSAEIESQIDRICEMGEVMRKAVQVDDDQFCKIQEKLAQLELENKELRELLSISSESLQARKENSMDTASQAIK

SEQ ID NO: 85142 - protein, 79 aa, Homo sapiens
  Payload ID: 16925
  Gene Symbol: ST20
  Gene Name: suppressor of tumorigenicity 20
  Uniprot ID: Q9HBF5
  ENSP ID: ENSP00000453502
MARSRLTATSVSQVQENGFVKKLEPKSGWMTFLEVTGKICEMLFCPEAILLTRKDTPYCETGLIFLTLTKTIANTYFYF

SEQ ID NO: 85143 - protein, 79 aa, Homo sapiens; identical to SEQ ID NO: 85142
  Payload ID: 16925
  Gene Symbol: ST20
  Gene Name: suppressor of tumorigenicity 20
  Uniprot ID: Q9HBF5
  ENSP ID: ENSP00000453693

SEQ ID NO: 85144 - protein, 79 aa, Homo sapiens; identical to SEQ ID NO: 85142
  Payload ID: 16925
  Gene Symbol: ST20
  Gene Name: suppressor of tumorigenicity 20
  Uniprot ID: Q9HBF5
  ENSP ID: ENSP00000457965

SEQ ID NO: 85145 - protein, 423 aa, Homo sapiens
  Payload ID: 16926
  Gene Symbol: SUV39H1
  Gene Name: suppressor of variegation 3-9 homolog 1 (Drosophila)
  Uniprot ID: O43463
  ENSP ID: ENSP00000337976
MVGMSRLRNDRLADPLTGCSVCCKSSWNQLQDLCRLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 85146 - protein, 412 aa, Homo sapiens
  Payload ID: 16926
  Gene Symbol: SUV39H1
  Gene Name: suppressor of variegation 3-9 homolog 1 (Drosophila)
  Uniprot ID: O43463
  ENSP ID: ENSP00000365877
MAENLKGCSVCCKSSWNQLQDLCRLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 85147 - protein, 350 aa, Homo sapiens
  Payload ID: 16927
  Gene Symbol: SUV39H2
  Gene Name: suppressor of variegation 3-9 homolog 2 (Drosophila)
  Uniprot ID: Q9H5I1
  ENSP ID: ENSP00000319208
MEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEYVGEVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 85148 - protein, 410 aa, Homo sapiens
  Payload ID: 16927
  Gene Symbol: SUV39H2
  Gene Name: suppressor of variegation 3-9 homolog 2 (Drosophila)
  Uniprot ID: Q9H5I1
  ENSP ID: ENSP00000346997
MAAVGAEARGAWCVPCLVSLDTLQELCRKEKLTCKSIGITKRNLNNYEVEYLCDYKVVKDMEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEYVGEVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 85149 - protein, 176 aa, Homo sapiens
  Payload ID: 16927
  Gene Symbol: SUV39H2
  Gene Name: suppressor of variegation 3-9 homolog 2 (Drosophila)
  ENSP ID: ENSP00000351046
  MOD_RES (1)..(1): Any amino acid
XWCVPCLVSLDTLQELCRKEKLTCKSIGITKRNLNNYEVEYLCDYKVVKVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 85150 - protein, 230 aa, Homo sapiens
  Payload ID: 16927
  Gene Symbol: SUV39H2
  Gene Name: suppressor of variegation 3-9 homolog 2 (Drosophila)
  Uniprot ID: Q9H5I1
  ENSP ID: ENSP00000367576
MAAVGAEARGAWCVPCLVSLDTLQELCRKEKLTCKSIGITKRNLNNYEVEYLCDYKVVKDMEYYLVKWKGWPDSTNTWEPLQNLKCPLLLQQFSNDKHNYLSQVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 85151 - protein, 45 aa, Homo sapiens
  Payload ID: 16927
  Gene Symbol: SUV39H2
  Gene Name: suppressor of variegation 3-9 homolog 2 (Drosophila)
  ENSP ID: ENSP00000367582
MAAVGAEARGGYGILSCKMERMARFYKYLGTFAKSEVPVTASAIL

SEQ ID NO: 85152 - protein, 95 aa, Homo sapiens
  Payload ID: 16927
  Gene Symbol: SUV39H2
  Gene Name: suppressor of variegation 3-9 homolog 2 (Drosophila)
  ENSP ID: ENSP00000388218
MEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIF

SEQ ID NO: 85153 - protein, 152 aa, Homo sapiens
  Payload ID: 16927
  Gene Symbol: SUV39H2
  Gene Name: suppressor of variegation 3-9 homolog 2 (Drosophila)
  ENSP ID: ENSP00000388968
MEYYLVKWKGWPDSTNTWEPLQNLKCPLLLQQFSNDKHNYLSQVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKK

SEQ ID NO: 85154 - protein, 220 aa, Homo sapiens
  Payload ID: 16927
  Gene Symbol: SUV39H2
  Gene Name: suppressor of variegation 3-9 homolog 2 (Drosophila)
  ENSP ID: ENSP00000392201
MEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEY

SEQ ID NO: 85155 - protein, 885 aa, Homo sapiens
  Payload ID: 16928
  Gene Symbol: SUV420H1
  Gene Name: suppressor of variegation 4-20 homolog 1 (Drosophila)
  Uniprot ID: Q4FZB7
  ENSP ID: ENSP00000305899
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNATSNRKSSVGVKKNSKSRTLTRQSMSRIPASSNSTSSKLTHINNSRVPKKLKKPAKPLLSKIKLRNHCKRLEQKNASRKLEMGNLVLKEPKVVLYKNLPIKKDKEPEGPAQAAVASGCLTRHAAREHRQNPVRGAHSQGESSPCTYITRRSVRTRTNLKEASDIKLEPNTLNGYKSSVTEPCPDSGEQLQPAPVLQEEELAHETAQKGEAKCHKSDTGMSKKKSRQGKLVKQFAKIEESTPVHDSPGKDDAVPDLMGPHSDQGEHSGTVGVPVSYTDCAPSPVGCSVVTSDSFKTKDSFRTAKSKKKRRITRYDAQLILENNSGIPKLTLRRRHDSSSKTNDQENDGMNSSKISIKLSKDHDNDNNLYVAKLNNGFNSGSGSSSTKLKIQLKRDEENRGSYTEGLHENGVCCSDPLSLLESRMEVDDYSQYEEESTDDSSSSEGDEEEDDYDDDFEDDFIPLPPAKRLRLIVGKDSIDIDISSRRREDQSLRLNA

SEQ ID NO: 85156 - protein, 103 aa, Homo sapiens
  Payload ID: 16928
  Gene Symbol: SUV420H1
  Gene Name: suppressor of variegation 4-20 homolog 1 (Drosophila)
  ENSP ID: ENSP00000313027
  MOD_RES (1)..(1): Any amino acid
XSDSFSHNNPVRFRPIKGRQEELKEVIERFKKDEHLEKAFKCLTSGEWARHYFLNKNKMQEKLFKEHRQNLALSPRLECSGLIMAHCSFHLLGSSDSSSQPPT

SEQ ID NO: 85157 - protein, 370 aa, Homo sapiens
  Payload ID: 16928
  Gene Symbol: SUV420H1
  Gene Name: suppressor of variegation 4-20 homolog 1 (Drosophila)
  ENSP ID: ENSP00000384724
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNASK

SEQ ID NO: 85158 - protein, 402 aa, Homo sapiens
  Payload ID: 16928
  Gene Symbol: SUV420H1
  Gene Name: suppressor of variegation 4-20 homolog 1 (Drosophila)
  ENSP ID: ENSP00000385005
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNAKNPEEKGRCFP

SEQ ID NO: 85159 - protein, 393 aa, Homo sapiens
  Payload ID: 16928
  Gene Symbol: SUV420H1
  Gene Name: suppressor of variegation 4-20 homolog 1 (Drosophila)
  Uniprot ID: Q4FZB7
  ENSP ID: ENSP00000385640
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDCRPNCKFVSTGRDTACVKALRDIEPGEEISCYYGDGFFGENNEFCECYTCERRGTGAFKSRVGLPAPAPVINSKYGLRETDKRLNRLKKLGDSSKNSDSQSVSSNTDADTTQEKNNASK

SEQ ID NO: 85160 - protein, 393 aa, Homo sapiens; identical to SEQ ID NO: 85159
  Payload ID: 16928
  Gene Symbol: SUV420H1
  Gene Name: suppressor of variegation 4-20 homolog 1 (Drosophila)
  Uniprot ID: Q4FZB7
  ENSP ID: ENSP00000385965

SEQ ID NO: 85161 - protein, 159 aa, Homo sapiens
  Payload ID: 16928
  Gene Symbol: SUV420H1
  Gene Name: suppressor of variegation 4-20 homolog 1 (Drosophila)
  ENSP ID: ENSP00000387685
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVSGETEKPNSKKTWEVSLWKEWGTDLGLLKEGRKN

SEQ ID NO: 85162 - protein, 118 aa, Homo sapiens
  Payload ID: 16928
  Gene Symbol: SUV420H1
  Gene Name: suppressor of variegation 4-20 homolog 1 (Drosophila)
  ENSP ID: ENSP00000402921
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDS

SEQ ID NO: 85163 - protein, 100 aa, Homo sapiens
  Payload ID: 16928
  Gene Symbol: SUV420H1
  Gene Name: suppressor of variegation 4-20 homolog 1 (Drosophila)
  ENSP ID: ENSP00000403233
MSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKN

SEQ ID NO: 85164 - protein, 120 aa, Homo sapiens
  Payload ID: 16928
  Gene Symbol: SUV420H1
  Gene Name: suppressor of variegation 4-20 homolog 1 (Drosophila)
  ENSP ID: ENSP00000406377
MSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFAT

SEQ ID NO: 85165 - protein, 278 aa, Homo sapiens
  Payload ID: 16928
  Gene Symbol: SUV420H1
  Gene Name: suppressor of variegation 4-20 homolog 1 (Drosophila)
  ENSP ID: ENSP00000411146
MKWLGESKNMVVNGRRNGGKLSNDHQQNQSKLQHTGKDTLKAGKNAVERRSNRCNGNSGFEGQSRYVPSSGMSAKELCENDDLATSLVLDPYLGFQTHKMNTSAFPSRSSRHFSKSDSFSHNNPVRFRPIKGRQEELKEVIERFKKDEHLEKAFKCLTSGEWARHYFLNKNKMQEKLFKEHVFIYLRMFATDSGFEILPCNRYSSEQNGAKIVATKEWKRNDKIELLVGCIAELSEIEENMLLRHGENDFSVMYSTRKNCAQLWLGPAAFINHDLINS

SEQ ID NO: 85166 - protein, 885 aa, Homo sapiens; identical to SEQ ID NO: 85155
  Payload ID: 16928
  Gene Symbol: SUV420H1
  Gene Name: suppressor of variegation 4-20 homolog 1 (Drosophila)
  Uniprot ID: Q4FZB7
  ENSP ID: ENSP00000484858

SEQ ID NO: 85167 - protein, 462 aa, Homo sapiens
  Payload ID: 16929
  Gene Symbol: SUV420H2
  Gene Name: suppressor of variegation 4-20 homolog 2 (Drosophila)
  Uniprot ID: Q86Y97
  ENSP ID: ENSP00000255613
MGPDRVTARELCENDDLATSLVLDPYLGFRTHKMNVSPVPPLRRQQHLRSALETFLRQRDLEAAYRALTLGGWTARYFQSRGPRQEAALKTHVYRYLRAFLPESGFTILPCTRYSMETNGAKIVSTRAWKKNEKLELLVGCIAELREADEGLLRAGENDFSIMYSTRKRSAQLWLGPAAFINHDCKPNCKFVPADGNAACVKVLRDIEPGDEVTCFYGEGFFGEKNEHCECHTCERKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 85168 - protein, 97 aa, Homo sapiens
  Payload ID: 16929
  Gene Symbol: SUV420H2
  Gene Name: suppressor of variegation 4-20 homolog 2 (Drosophila)
  Uniprot ID: Q86Y97
  ENSP ID: ENSP00000397296
MGPDRVTARELCENDDLATSLVLDPYLGFRTHKMNVRSIATSVPSCRKVALPSCPARATPWRPTGPRSCPLVLGKRMRSWSCWWAALQSCGRQMRGC

SEQ ID NO: 85169 - protein, 97 aa, Homo sapiens; identical to SEQ ID NO: 85168
  Payload ID: 16929
  Gene Symbol: SUV420H2
  Gene Name: suppressor of variegation 4-20 homolog 2 (Drosophila)
  Uniprot ID: Q86Y97
  ENSP ID: ENSP00000467499

SEQ ID NO: 85170 - protein, 347 aa, Homo sapiens
  Payload ID: 16929
  Gene Symbol: SUV420H2
  Gene Name: suppressor of variegation 4-20 homolog 2 (Drosophila)
  ENSP ID: ENSP00000486397
METNGAKIVSTRAWKKNEKLELLVGCIAELREADEGLLRAGENDFSIMYSTRKRSAQLWLGPAAFINHDCKPNCKFVPADGNAACVKVLRDIEPGDEVTCFYGEGFFGEKNEHCECHTCERKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 85171 - protein, 247 aa, Homo sapiens
  Payload ID: 16930
  Gene Symbol: SBSN
  Gene Name: suprabasin
  Uniprot ID: Q6UWP8
  ENSP ID: ENSP00000428771
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 85172 - protein, 590 aa, Homo sapiens
  Payload ID: 16930
  Gene Symbol: SBSN
  Gene Name: suprabasin
  Uniprot ID: Q6UWP8
  ENSP ID: ENSP00000430242
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQVGKEADKLIHHGVHHGANQAGSEAGKFGQGVDNAAGQAGNEAGRFGQGVHHAAGQAGNEAGRFGQGVHHAAGQAGNEAGRFGQGAHHGLSEGWKETEKFGQGIHHAAGQVGKEAEKFGQGAHHAAGQAGNEAGRFGQGVHHGLSEGWKETEKFGQGVHHTAGQVGKEAEKFGQGAHHAAGQAGNEAGRFGQGAHHAAGQAGNEAGRFGQGVHHGLSEGWKETEKFGQGVHHAASQFGKETEKLGHGVHHGVNEAWKEAEKFGQGVHHAASQVGKEEDRVVQGLHHGVSQAGREAGQFGHDIHHTAGQAGKEGDIAVHGVQPGVHEAGKEAGQFGQGVHHTLEQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 85173 - protein, 149 aa, Homo sapiens
  Payload ID: 16930
  Gene Symbol: SBSN
  Gene Name: suprabasin
  ENSP ID: ENSP00000468646
GWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQGNHQSGSSSHQGGATTTPLASGASVNTPFINLPALWRSVANIMP

SEQ ID NO: 85174 - protein, 78 aa, Homo sapiens
  Payload ID: 16931
  Gene Symbol: SFTA2
  Gene Name: surfactant associated 2
  Uniprot ID: Q6UW10
  ENSP ID: ENSP00000351989
MGSGLPLVLLLTLLGSSHGTGPGMTLQLKLKESFLTNSSYESSFLELLEKLCLLLHLPSGTSVTLHHARSQHHVVCNT

SEQ ID NO: 85175 - protein, 78 aa, Homo sapiens; identical to SEQ ID NO: 85174
  Payload ID: 16931
  Gene Symbol: SFTA2
  Gene Name: surfactant associated 2
  Uniprot ID: Q6UW10
  ENSP ID: ENSP00000373031

SEQ ID NO: 85176 - protein, 78 aa, Homo sapiens; identical to SEQ ID NO: 85174
  Payload ID: 16931
  Gene Symbol: SFTA2
  Gene Name: surfactant associated 2
  Uniprot ID: Q6UW10
  ENSP ID: ENSP00000390291

SEQ ID NO: 85177 - protein, 78 aa, Homo sapiens; identical to SEQ ID NO: 85174
  Payload ID: 16931
  Gene Symbol: SFTA2
  Gene Name: surfactant associated 2
  Uniprot ID: Q6UW10
  ENSP ID: ENSP00000398777

SEQ ID NO: 85178 - protein, 78 aa, Homo sapiens; identical to SEQ ID NO: 85174
  Payload ID: 16931
  Gene Symbol: SFTA2
  Gene Name: surfactant associated 2
  Uniprot ID: Q6UW10
  ENSP ID: ENSP00000407762

SEQ ID NO: 85179 - protein, 78 aa, Homo sapiens
  Payload ID: 16931
  Gene Symbol: SFTA2
  Gene Name: surfactant associated 2
  ENSP ID: ENSP00000409248
MGSGLPLVLLLTLLGSSHGTGPGMTLQLKLKESFLTSSSYESSFLELLEKLCLLLHLPSGTSVTLHHARSQHHVVCNT

SEQ ID NO: 85180 - protein, 55 aa, Homo sapiens
  Payload ID: 16931
  Gene Symbol: SFTA2
  Gene Name: surfactant associated 2
  ENSP ID: ENSP00000489572
MTLQLKLKESFLTNSSYESSFLELLEKLCLLLHLPSGTSVTLHHARSQHHVVCNT

SEQ ID NO: 85181 - protein, 76 aa, Homo sapiens
  Payload ID: 16932
  Gene Symbol: SFTA3
  Gene Name: surfactant associated 3
  ENSP ID: ENSP00000427853
MRAGFSDFQLIRDQVLFLQDQAQRLTEWLQLSGFENPVSESTTLYGGGEETSGDQLDIQSSPGHMERTNVRSARSL

SEQ ID NO: 85182 - protein, 76 aa, Homo sapiens; identical to SEQ ID NO: 85181
  Payload ID: 16932
  Gene Symbol: SFTA3
  Gene Name: surfactant associated 3
  ENSP ID: ENSP00000428198

SEQ ID NO: 85183 - protein, 95 aa, Homo sapiens
  Payload ID: 16932
  Gene Symbol: SFTA3
  Gene Name: surfactant associated 3
  ENSP ID: ENSP00000428247
MRAGFSDFQLIRDQVLFLQDQAQRLTEWLQLSGFENPVSESTTLCLREREKRIPTCVAVCVPSPGTVHTALLHPTTLSQSRSSSEAKMEKLRPRN

SEQ ID NO: 85184 - protein, 94 aa, Homo sapiens
  Payload ID: 16932
  Gene Symbol: SFTA3
  Gene Name: surfactant associated 3
  Uniprot ID: P0C7M3
  ENSP ID: ENSP00000428331
MRAGFSDFQLIRDQVLFLQDQAQRLTEWLQLSGFENPVSESTTLCLREREKRIPTCVAVCVPSPGTVHTALLHPTTLSQSRSSSEAKMLIIHTA

SEQ ID NO: 85185 - protein, 76 aa, Homo sapiens; identical to SEQ ID NO: 85181
  Payload ID: 16932
  Gene Symbol: SFTA3
  Gene Name: surfactant associated 3
  ENSP ID: ENSP00000429830

SEQ ID NO: 85186 - protein, 248 aa, Homo sapiens
  Payload ID: 16933
  Gene Symbol: SFTPA1
  Gene Name: surfactant protein A1
  Uniprot ID: Q8IWL2
  ENSP ID: ENSP00000381633
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 85187 - protein, 158 aa, Homo sapiens
  Payload ID: 16933
  Gene Symbol: SFTPA1
  Gene Name: surfactant protein A1
  ENSP ID: ENSP00000395527
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARA

SEQ ID NO: 85188 - protein, 263 aa, Homo sapiens
  Payload ID: 16933
  Gene Symbol: SFTPA1
  Gene Name: surfactant protein A1
  Uniprot ID: Q8IWL2
  ENSP ID: ENSP00000397082
MRPCQVPGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 85189 - protein, 158 aa, Homo sapiens; identical to SEQ ID NO: 85187
  Payload ID: 16933
  Gene Symbol: SFTPA1
  Gene Name: surfactant protein A1
  ENSP ID: ENSP00000401649

SEQ ID NO: 85190 - protein, 248 aa, Homo sapiens; identical to SEQ ID NO: 85186
  Payload ID: 16933
  Gene Symbol: SFTPA1
  Gene Name: surfactant protein A1
  Uniprot ID: Q8IWL2
  ENSP ID: ENSP00000411102

SEQ ID NO: 85191 - protein, 248 aa, Homo sapiens
  Payload ID: 16934
  Gene Symbol: SFTPA2
  Gene Name: surfactant protein A2
  Uniprot ID: Q8IWL1
  ENSP ID: ENSP00000361400
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 85192 - protein, 248 aa, Homo sapiens; identical to SEQ ID NO: 85191
  Payload ID: 16934
  Gene Symbol: SFTPA2
  Gene Name: surfactant protein A2
  Uniprot ID: Q8IWL1
  ENSP ID: ENSP00000361402

SEQ ID NO: 85193 - protein, 158 aa, Homo sapiens
  Payload ID: 16934
  Gene Symbol: SFTPA2
  Gene Name: surfactant protein A2
  ENSP ID: ENSP00000397375
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARA

SEQ ID NO: 85194 - protein, 97 aa, Homo sapiens
  Payload ID: 16934
  Gene Symbol: SFTPA2
  Gene Name: surfactant protein A2
  ENSP ID: ENSP00000473275
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPP

SEQ ID NO: 85195 - protein, 381 aa, Homo sapiens
  Payload ID: 16935
  Gene Symbol: SFTPB
  Gene Name: surfactant protein B
  Uniprot ID: P07988
  ENSP ID: ENSP00000377409
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 85196 - protein, 393 aa, Homo sapiens
  Payload ID: 16935
  Gene Symbol: SFTPB
  Gene Name: surfactant protein B
  ENSP ID: ENSP00000386346
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 85197 - protein, 374 aa, Homo sapiens
  Payload ID: 16935
  Gene Symbol: SFTPB
  Gene Name: surfactant protein B
  ENSP ID: ENSP00000415347
  MOD_RES (1)..(1): Any amino acid
XHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPREWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 85198 - protein, 381 aa, Homo sapiens; identical to SEQ ID NO: 85195
  Payload ID: 16935
  Gene Symbol: SFTPB
  Gene Name: surfactant protein B
  Uniprot ID: P07988
  ENSP ID: ENSP00000428719

SEQ ID NO: 85199 - protein, 92 aa, Homo sapiens
  Payload ID: 16935
  Gene Symbol: SFTPB
  Gene Name: surfactant protein B
  ENSP ID: ENSP00000476194
  MOD_RES (1)..(1): Any amino acid
XEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 85200 - protein, 197 aa, Homo sapiens [sequence omitted]

SEQ ID NO: 85201 - protein, 161 aa, Homo sapiens
  Payload ID: 16936
  Gene Symbol: SFTPC
  Gene Name: surfactant protein C
  ENSP ID: ENSP00000407931
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFQHSPSLLMRKLRLREIA

SEQ ID NO: 85202 - protein, 150 aa, Homo sapiens
  Payload ID: 16936
  Gene Symbol: SFTPC
  Gene Name: surfactant protein C
  ENSP ID: ENSP00000429496
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFQVCVCG

SEQ ID NO: 85203 - protein, 144 aa, Homo sapiens
  Payload ID: 16936
  Gene Symbol: SFTPC
  Gene Name: surfactant protein C
  ENSP ID: ENSP00000429552
MDVGSKEVLMESPPVLEMSIGAPEAQQRLALSEHLVTTATFSIGSTGLVVYDYQQLLIAYKPAPGTCCYIMKIAPESIPSLEALTRKVHNFQMECSLQAKPAVPTSKLGQAEGRDAGSAPSGGDPAFLGMAVSTLCGEVPLYYI

SEQ ID NO: 85204 - protein, 124 aa, Homo sapiens
  Payload ID: 16936
  Gene Symbol: SFTPC
  Gene Name: surfactant protein C
  ENSP ID: ENSP00000429619
MDVGSKEVLMESPPVLEMSIGAPEAQQRLALSEHLVTTATFSIGSTGLVVYDYQQLLIAYKPAPGTCCYIMKIAPESIPSLEALTRKVHNFQAKPAVPTSKLGQAEGRDAGSAPSGGDPAFLGM

SEQ ID NO: 85205 - protein, 155 aa, Homo sapiens
  Payload ID: 16936
  Gene Symbol: SFTPC
  Gene Name: surfactant protein C
  ENSP ID: ENSP00000430266
MDVGSKEVLMESPPVLEMSIGAPEAQQRLALSEHLVTTATFSIGSTGLVVYDYQQLLIAYKPAPGTCCYIMKIAPESIPSLEALTRKVHNFQGQWKPQRERKRPGQRVFCSFCRRARSCFCPHRRDKPWRNGSLGRGWEWAEVAPRGPGTPATTE

SEQ ID NO: 85206 - protein, 191 aa, Homo sapiens
  Payload ID: 16936
  Gene Symbol: SFTPC
  Gene Name: surfactant protein C
  ENSP ID: ENSP00000430410
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFQAKPAVPTSKLGQAEGRDAGSAPSGGDPAFLGMAVSTLCGEVPLYYI

SEQ ID NO: 85207 - protein, 375 aa, Homo sapiens
  Payload ID: 16937
  Gene Symbol: SFTPD
  Gene Name: surfactant protein D
  Uniprot ID: P35247
  ENSP ID: ENSP00000361366
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 85208 - protein, 218 aa, Homo sapiens
  Payload ID: 16937
  Gene Symbol: SFTPD
  Gene Name: surfactant protein D
  ENSP ID: ENSP00000394325
MFLSTSKHGRQEAMLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKG

SEQ ID NO: 85209 - protein, 300 aa, Homo sapiens
  Payload ID: 16938
  Gene Symbol: SURF1
  Gene Name: surfeit 1
  Uniprot ID: Q15526
  ENSP ID: ENSP00000361042
MAAVAALQLGLRAAGLGRAPASAAWRSVLRVSPRPGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 85210 - protein, 191 aa, Homo sapiens
  Payload ID: 16938
  Gene Symbol: SURF1
  Gene Name: surfeit 1
  ENSP ID: ENSP00000482067
MELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 85211 - protein, 191 aa, Homo sapiens; identical to SEQ ID NO: 85210
  Payload ID: 16938
  Gene Symbol: SURF1
  Gene Name: Surfeit 1
  ENSP ID: ENSP00000486289

SEQ ID NO: 85212 - protein, 300 aa, Homo sapiens; identical to SEQ ID NO: 85209
  Payload ID: 16938
  Gene Symbol: SURF1
  Gene Name: Surfeit 1
  ENSP ID: ENSP00000487158

SEQ ID NO: 85213 - protein, 256 aa, Homo sapiens
  Payload ID: 16939
  Gene Symbol: SURF2
  Gene Name: surfeit 2
  Uniprot ID: Q15527
  ENSP ID: ENSP00000361032
MSELPGDVRAFLREHPSLRLQTDARKVRCILTGHELPCRLPELQVYTRGKKYQRLVRASPAFDYAEFEPHIVPSTKNPHQLFCKLTLRHINKCPEHVLRHTQGRRYQRALCKYEECQKQGVEYVPACLVHRRRRREDQMDGDGPRPREAFWEPTSSDEGGAASDDSMTDLYPPELFTRKDLGSTEDGDGTDDFLTDKEDEKAKPPREKATDEGRRETTVYRGLVQKRGKKQLGSLKKKFKSHHRKPKSFSSCKQPG

SEQ ID NO: 85214 - protein, 256 aa, Homo sapiens; identical to SEQ ID NO: 85213
  Payload ID: 16939
  Gene Symbol: SURF2
  Gene Name: Surfeit 2
  ENSP ID: ENSP00000487370

SEQ ID NO: 85215 - protein, 269 aa, Homo sapiens; identical to SEQ ID NO: 38914
  Payload ID: 16940
  Gene Symbol: SURF4
  Gene Name: surfeit 4
  Uniprot ID: O15260
  ENSP ID: ENSP00000361057

SEQ ID NO: 85216 - protein, 186 aa, Homo sapiens; identical to SEQ ID NO: 38917
  Payload ID: 16940
  Gene Symbol: SURF4
  Gene Name: surfeit 4
  ENSP ID: ENSP00000361059

SEQ ID NO: 85217 - protein, 159 aa, Homo sapiens; identical to SEQ ID NO: 38918
  Payload ID: 16940
  Gene Symbol: SURF4
  Gene Name: surfeit 4
  Uniprot ID: O15260
  ENSP ID: ENSP00000419853

SEQ ID NO: 85218 - protein, 128 aa, Homo sapiens; identical to SEQ ID NO: 38916
  Payload ID: 16940
  Gene Symbol: SURF4
  Gene Name: surfeit 4
  Uniprot ID: O15260
  ENSP ID: ENSP00000446061

SEQ ID NO: 85219 - protein, 226 aa, Homo sapiens; identical to SEQ ID NO: 38913
  Payload ID: 16940
  Gene Symbol: SURF4
  Gene Name: surfeit 4
  ENSP ID: ENSP00000481666

SEQ ID NO: 85220 - protein, 226 aa, Homo sapiens; identical to SEQ ID NO: 38913
  Payload ID: 16940
  Gene Symbol: SURF4
  Gene Name: surfeit 4
  ENSP ID: ENSP00000483216

SEQ ID NO: 85221 - protein, 361 aa, Homo sapiens
  Payload ID: 16941
  Gene Symbol: SURF6
  Gene Name: surfeit 6
  Uniprot ID: O75683
  ENSP ID: ENSP00000361092
MASLLAKDAYLQSLAKKICSHSAPEQQARTRAGKTQGSETAGPPKKKRKKTQKKFRKREEKAAEHKAKSLGEKSPAASGARRPEAAKEEAAWASSSAGNPADGLATEPESVFALDVLRQRLHEKIQEARGQGSAKELSPAALEKRRRRKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 85222 - protein, 361 aa, Homo sapiens; identical to SEQ ID NO: 85221
  Payload ID: 16942
  Gene Symbol:
  Gene Name: Surfeit locus protein 6  [Source:UniProtKB/Swiss-Prot
  Acc:O75683]
  Uniprot ID: O75683
  ENSP ID: ENSP00000485909

SEQ ID NO: 85223 - protein, 645 aa, Homo sapiens
  Payload ID: 16943
  Gene Symbol: SUGP1
  Gene Name: SURP and G patch domain containing 1
  Uniprot ID: Q8IWZ8
  ENSP ID: ENSP00000247001
MSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 85224 - protein, 185 aa, Homo sapiens
  Payload ID: 16943
  Gene Symbol: SUGP1
  Gene Name: SURP and G patch domain containing 1
  ENSP ID: ENSP00000439172
MSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKGRRWLR

SEQ ID NO: 85225 - protein, 222 aa, Homo sapiens
  Payload ID: 16943
  Gene Symbol: SUGP1
  Gene Name: SURP and G patch domain containing 1
  Uniprot ID: Q8IWZ8
  ENSP ID: ENSP00000465413
MSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVCLTKTVRPTPPSSWCFVPGLGTPDSLLHLTLFSPHPLCRCGP

SEQ ID NO: 85226 - protein, 129 aa, Homo sapiens
  Payload ID: 16943
  Gene Symbol: SUGP1
  Gene Name: SURP and G patch domain containing 1
  ENSP ID: ENSP00000466188
MSLKMDNRDVAGKANRWFGVAPPKSGKMNMNILHQEELIAQKKREIEAKMEQKAKQNQVASPQPPHPGERPDQCAQRPSQHTHPQRWEEVPAHQQADRPGAGQPAGPCEELLPRQAAARGAPPECLPVP

SEQ ID NO: 85227 - protein, 78 aa, Homo sapiens
  Payload ID: 16943
  Gene Symbol: SUGP1
  Gene Name: SURP and G patch domain containing 1
  ENSP ID: ENSP00000466402
  MOD_RES (1)..(1): Any amino acid
XETRKVIEKLARFVAEGGPELEKVAMEDYKDNPAFAFLHDKNSREFLYYRKKVAEIRKEAQKSQAASQKEIRLLGVVS

SEQ ID NO: 85228 - protein, 36 aa, Homo sapiens
  Payload ID: 16943
  Gene Symbol: SUGP1
  Gene Name: SURP and G patch domain containing 1
  ENSP ID: ENSP00000468499
MSLKMDNRDVAESQMHTTLPAFPTSLPTMVASCSSF

SEQ ID NO: 85229 - protein, 69 aa, Homo sapiens
  Payload ID: 16943
  Gene Symbol: SUGP1
  Gene Name: SURP and G patch domain containing 1
  ENSP ID: ENSP00000468771
MSLKMDNRDVAGKANRWFGVAPPKSGKMNMNILHQEELIAQKKREIEAKMEQKAKQNQVASPQPPHPGE

SEQ ID NO: 85230 - protein, 242 aa, Homo sapiens
  Payload ID: 16943
  Gene Symbol: SUGP1
  Gene Name: SURP and G patch domain containing 1
  ENSP ID: ENSP00000477290
MLQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFI

SEQ ID NO: 85231 - protein, 1030 aa, Homo sapiens
  Payload ID: 16944
  Gene Symbol: SUGP2
  Gene Name: SURP and G patch domain containing 2
  Uniprot ID: Q8IX01
  ENSP ID: ENSP00000332373
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGGSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 85232 - protein, 1082 aa, Homo sapiens
  Payload ID: 16944
  Gene Symbol: SUGP2
  Gene Name: SURP and G patch domain containing 2
  Uniprot ID: Q8IX01
  ENSP ID: ENSP00000337926
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGGSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 85233 - protein, 1082 aa, Homo sapiens; identical to SEQ ID NO: 85232
  Payload ID: 16944
  Gene Symbol: SUGP2
  Gene Name: SURP and G patch domain containing 2
  Uniprot ID: Q8IX01
  ENSP ID: ENSP00000389380

SEQ ID NO: 85234 - protein, 1040 aa, Homo sapiens
  Payload ID: 16944
  Gene Symbol: SUGP2
  Gene Name: SURP and G patch domain containing 2
  Uniprot ID: Q8IX01
  ENSP ID: ENSP00000470915
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGGSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 85235 - protein, 111 aa, Homo sapiens
  Payload ID: 16944
  Gene Symbol: SUGP2
  Gene Name: SURP and G patch domain containing 2
  ENSP ID: ENSP00000471042
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDL

SEQ ID NO: 85236 - protein, 53 aa, Homo sapiens
  Payload ID: 16944
  Gene Symbol: SUGP2
  Gene Name: SURP and G patch domain containing 2
  ENSP ID: ENSP00000472183
  MOD_RES (1)..(1): Any amino acid
XHEPVRIAYDRPRGRPMSKKKGPGRAQLPEGPDGCPVSHLSRNPRTWTSPSRS

SEQ ID NO: 85237 - protein, 170 aa, Homo sapiens
  Payload ID: 16944
  Gene Symbol: SUGP2
  Gene Name: SURP and G patch domain containing 2
  ENSP ID: ENSP00000472244
  MOD_RES (1)..(1): Any amino acid
XLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFDPSGAGSEESSAPQKKDEL

SEQ ID NO: 85238 - protein, 1082 aa, Homo sapiens; identical to SEQ ID NO: 85232
  Payload ID: 16944
  Gene Symbol: SUGP2
  Gene Name: SURP and G patch domain containing 2
  Uniprot ID: Q8IX01
  ENSP ID: ENSP00000472286

SEQ ID NO: 85239 - protein, 65 aa, Homo sapiens
  Payload ID: 16944
  Gene Symbol: SUGP2
  Gene Name: SURP and G patch domain containing 2
  ENSP ID: ENSP00000472878
  MOD_RES (1)..(1): Any amino acid
XSGTCFPRKRISSKSLKVGMIPAPKRVCLIQEPKEARTHQYSRAEACSQNGSLVPLQSPARFSNH

SEQ ID NO: 85240 - protein, 1096 aa, Homo sapiens
  Payload ID: 16944
  Gene Symbol: SUGP2
  Gene Name: SURP and G patch domain containing 2
  ENSP ID: ENSP00000472914
MSPPRAAAAAGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGGSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 85241 - protein, 841 aa, Homo sapiens
  Payload ID: 16944
  Gene Symbol: SUGP2
  Gene Name: SURP and G patch domain containing 2
  ENSP ID: ENSP00000473187
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGGSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWGPAFISGIRKNLPRGTFNLHPKAK

SEQ ID NO: 85242 - protein, 238 aa, Homo sapiens
  Payload ID: 16945
  Gene Symbol: SMNDC1
  Gene Name: survival motor neuron domain containing 1
  Uniprot ID: O75940
  ENSP ID: ENSP00000358605
MSEDLAKQLASYKAQLQQVEAALSGNGENEDLLKLKKDLQEVIELTKDLLSTQPSETLASSDSFASTQPTHSWKVGDKCMAVWSEDGQCYEAEIEEIDEENGTAAITFAGYGNAEVTPLLNLKPVEEGRKAKEDSGNKPMSKKEMIAQQREYKKKKALKKAQRIKELEQEREDQKVKWQQFNNRAYSKNKKGQVKRSIFASPESVTGKVGVGTCGIADKPMTQYQDTSKYNVRHLMPQ

SEQ ID NO: 85243 - protein, 238 aa, Homo sapiens; identical to SEQ ID NO: 85242
  Payload ID: 16945
  Gene Symbol: SMNDC1
  Gene Name: survival motor neuron domain containing 1
  Uniprot ID: O75940
  ENSP ID: ENSP00000358616

SEQ ID NO: 85244 - protein, 294 aa, Homo sapiens
  Payload ID: 16946
  Gene Symbol: SMN1
  Gene Name: survival of motor neuron 1, telomeric
  Uniprot ID: Q16637
  ENSP ID: ENSP00000305857
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 85245 - protein, 294 aa, Homo sapiens; identical to SEQ ID NO: 85244
  Payload ID: 16946
  Gene Symbol: SMN1
  Gene Name: survival of motor neuron 1, telomeric
  Uniprot ID: Q16637
  ENSP ID: ENSP00000370083

SEQ ID NO: 85246 - protein, 294 aa, Homo sapiens
  Payload ID: 16946
  Gene Symbol: SMN1
  Gene Name: survival of motor neuron 1, telomeric
  ENSP ID: ENSP00000422679
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMTGFHCVSQDGLNLLTP

SEQ ID NO: 85247 - protein, 227 aa, Homo sapiens
  Payload ID: 16946
  Gene Symbol: SMN1
  Gene Name: survival of motor neuron 1, telomeric
  ENSP ID: ENSP00000423298
MAMSSGGSGGGVPEQEDSVLFRRGTGQSDDSDIWDDTALIKAYDKAVASFKHALKNGDICETSGKPKTTPKRKPAKKNKSQKKNTAASLQQNENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 85248 - protein, 282 aa, Homo sapiens
  Payload ID: 16946
  Gene Symbol: SMN1
  Gene Name: survival of motor neuron 1, telomeric
  Uniprot ID: Q16637
  ENSP ID: ENSP00000424926
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMEMLA

SEQ ID NO: 85249 - protein, 262 aa, Homo sapiens
  Payload ID: 16946
  Gene Symbol: SMN1
  Gene Name: survival of motor neuron 1, telomeric
  Uniprot ID: Q16637
  ENSP ID: ENSP00000428128
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMGFRQNQKEGRCSHSLN

SEQ ID NO: 85250 - protein, 79 aa, Homo sapiens
  Payload ID: 16946
  Gene Symbol: SMN1
  Gene Name: survival of motor neuron 1, telomeric
  ENSP ID: ENSP00000430657
LSPICEVANNIEQNAQENENESQVSTDESENSRSPGNKSDNIKPKSAPWNSFLPPPPPMPGPRLGPGKKGNEKNPEVVI

SEQ ID NO: 85251 - protein, 294 aa, Homo sapiens; identical to SEQ ID NO: 85246
  Payload ID: 16946
  Gene Symbol: SMN1
  Gene Name: survival of motor neuron 1, telomeric
  ENSP ID: ENSP00000477738

SEQ ID NO: 85252 - protein, 262 aa, Homo sapiens; identical to SEQ ID NO: 85249
  Payload ID: 16946
  Gene Symbol: SMN1
  Gene Name: survival of motor neuron 1, telomeric
  Uniprot ID: Q16637
  ENSP ID: ENSP00000480906

SEQ ID NO: 85253 - protein, 294 aa, Homo sapiens; identical to SEQ ID NO: 85244
  Payload ID: 16946
  Gene Symbol: SMN1
  Gene Name: survival of motor neuron 1, telomeric
  Uniprot ID: Q16637
  ENSP ID: ENSP00000482966

SEQ ID NO: 85254 - protein, 149 aa, Homo sapiens
  Payload ID: 16946
  Gene Symbol: SMN1
  Gene Name: survival of motor neuron 1, telomeric
  ENSP ID: ENSP00000486022
  MOD_RES (1)..(1): Any amino acid
XNTAASLQQWKVGDKCSAIWSEDGCIYPATIASIDFKRETCVVVYTGYGNREEQNLSDLLSPICEVANNIEQNAQEPGLKFNGPPPPPPPPPPHLLSCWLPPFPSGPPIIPPPPPICPDSLDDADALGSMLISWYMSGYHTGYYMEMLA

SEQ ID NO: 85255 - protein, 294 aa, Homo sapiens; identical to SEQ ID NO: 85246
  Payload ID: 16946
  Gene Symbol: SMN1
  Gene Name: survival of motor neuron 1, telomeric
  ENSP ID: ENSP00000486539

SEQ ID NO: 85256 - protein, 282 aa, Homo sapiens; identical to SEQ ID NO: 85248
  Payload ID: 16946
  Gene Symbol: SMN1
  Gene Name: survival of motor neuron 1, telomeric
  Uniprot ID: Q16637
  ENSP ID: ENSP00000487029

SEQ ID NO: 85257 - protein, 143 aa, Homo sapiens
  Payload ID: 16946
  Gene Symbol: SMN1
  Gene Name: survival of motor neuron 1, telomeric
  ENSP ID: ENSP00000487162
  MOD_RES (1)..(1): Any amino acid
XNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKGFRQNQKEGRCSHSLN

SEQ ID NO: 85258 - protein, 180 aa, Homo sapiens
  Payload ID: 16946
  Gene Symbol: SMN1
  Gene Name: survival of motor neuron 1, telomeric
  ENSP ID: ENSP00000487186
  MOD_RES (1)..(1): Any amino acid
XNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMGFRQNQKEGRCSHSLN

SEQ ID NO: 85259 - protein, 79 aa, Homo sapiens; identical to SEQ ID NO: 85250
  Payload ID: 16946
  Gene Symbol: SMN1
  Gene Name: survival of motor neuron 1, telomeric
  ENSP ID: ENSP00000487193

SEQ ID NO: 85260 - protein, 294 aa, Homo sapiens; identical to SEQ ID NO: 85244
  Payload ID: 16946
  Gene Symbol: SMN1
  Gene Name: survival of motor neuron 1, telomeric
  Uniprot ID: Q16637
  ENSP ID: ENSP00000487206

SEQ ID NO: 85261 - protein, 227 aa, Homo sapiens; identical to SEQ ID NO: 85247
  Payload ID: 16946
  Gene Symbol: SMN1
  Gene Name: survival of motor neuron 1, telomeric
  ENSP ID: ENSP00000487289

SEQ ID NO: 85262 - protein, 294 aa, Homo sapiens; identical to SEQ ID NO: 85244
  Payload ID: 16947
  Gene Symbol: SMN2
  Gene Name: survival of motor neuron 2, centromeric
  Uniprot ID: Q16637
  ENSP ID: ENSP00000370117

SEQ ID NO: 85263 - protein, 262 aa, Homo sapiens; identical to SEQ ID NO: 85249
  Payload ID: 16947
  Gene Symbol: SMN2
  Gene Name: survival of motor neuron 2, centromeric
  Uniprot ID: Q16637
  ENSP ID: ENSP00000370118

SEQ ID NO: 85264 - protein, 294 aa, Homo sapiens; identical to SEQ ID NO: 85244
  Payload ID: 16947
  Gene Symbol: SMN2
  Gene Name: survival of motor neuron 2, centromeric
  Uniprot ID: Q16637
  ENSP ID: ENSP00000370119

SEQ ID NO: 85265 - protein, 227 aa, Homo sapiens; identical to SEQ ID NO: 85247
  Payload ID: 16947
  Gene Symbol: SMN2
  Gene Name: survival of motor neuron 2, centromeric
  ENSP ID: ENSP00000424282

SEQ ID NO: 85266 - protein, 294 aa, Homo sapiens; identical to SEQ ID NO: 85246
  Payload ID: 16947
  Gene Symbol: SMN2
  Gene Name: survival of motor neuron 2, centromeric
  ENSP ID: ENSP00000424799

SEQ ID NO: 85267 - protein, 46 aa, Homo sapiens
  Payload ID: 16947
  Gene Symbol: SMN2
  Gene Name: survival of motor neuron 2, centromeric
  ENSP ID: ENSP00000475331
  MOD_RES (1)..(1): Any amino acid
XCPDSLDDADALGSMLISWYMSGYHTGYYMGFRQNQKEGRCSHSLN

SEQ ID NO: 85268 - protein, 79 aa, Homo sapiens; identical to SEQ ID NO: 85250
  Payload ID: 16947
  Gene Symbol: SMN2
  Gene Name: survival of motor neuron 2, centromeric
  ENSP ID: ENSP00000475824

SEQ ID NO: 85269 - protein, 294 aa, Homo sapiens; identical to SEQ ID NO: 85246
  Payload ID: 16947
  Gene Symbol: SMN2
  Gene Name: survival of motor neuron 2, centromeric
  ENSP ID: ENSP00000477720

SEQ ID NO: 85270 - protein, 294 aa, Homo sapiens; identical to SEQ ID NO: 85246
  Payload ID: 16947
  Gene Symbol: SMN2
  Gene Name: survival of motor neuron 2, centromeric
  ENSP ID: ENSP00000478274

SEQ ID NO: 85271 - protein, 227 aa, Homo sapiens; identical to SEQ ID NO: 85247
  Payload ID: 16947
  Gene Symbol: SMN2
  Gene Name: survival of motor neuron 2, centromeric
  ENSP ID: ENSP00000478583

SEQ ID NO: 85272 - protein, 262 aa, Homo sapiens; identical to SEQ ID NO: 85249
  Payload ID: 16947
  Gene Symbol: SMN2
  Gene Name: survival of motor neuron 2, centromeric
  Uniprot ID: Q16637
  ENSP ID: ENSP00000479279

SEQ ID NO: 85273 - protein, 294 aa, Homo sapiens; identical to SEQ ID NO: 85244
  Payload ID: 16947
  Gene Symbol: SMN2
  Gene Name: survival of motor neuron 2, centromeric
  Uniprot ID: Q16637
  ENSP ID: ENSP00000479920

SEQ ID NO: 85274 - protein, 46 aa, Homo sapiens; identical to SEQ ID NO: 85267
  Payload ID: 16947
  Gene Symbol: SMN2
  Gene Name: survival of motor neuron 2, centromeric
  ENSP ID: ENSP00000480541
  MOD_RES (1)..(1): Any amino acid

SEQ ID NO: 85275 - protein, 262 aa, Homo sapiens; identical to SEQ ID NO: 85249
  Payload ID: 16947
  Gene Symbol: SMN2
  Gene Name: survival of motor neuron 2, centromeric
  Uniprot ID: Q16637
  ENSP ID: ENSP00000481427

SEQ ID NO: 85276 - protein, 79 aa, Homo sapiens; identical to SEQ ID NO: 85250
  Payload ID: 16947
  Gene Symbol: SMN2
  Gene Name: survival of motor neuron 2, centromeric
  ENSP ID: ENSP00000482226

SEQ ID NO: 85277 - protein, 294 aa, Homo sapiens; identical to SEQ ID NO: 85244
  Payload ID: 16947
  Gene Symbol: SMN2
  Gene Name: survival of motor neuron 2, centromeric
  Uniprot ID: Q16637
  ENSP ID: ENSP00000483515

SEQ ID NO: 85278 - protein, 262 aa, Homo sapiens; identical to SEQ ID NO: 85249
  Payload ID: 16947
  Gene Symbol: SMN2
  Gene Name: survival of motor neuron 2, centromeric
  Uniprot ID: Q16637
  ENSP ID: ENSP00000483768

SEQ ID NO: 85279 - protein, 294 aa, Homo sapiens; identical to SEQ ID NO: 85244
  Payload ID: 16947
  Gene Symbol: SMN2
  Gene Name: survival of motor neuron 2, centromeric
  Uniprot ID: Q16637
  ENSP ID: ENSP00000483819

SEQ ID NO: 85280 - protein, 262 aa, Homo sapiens; identical to SEQ ID NO: 85249
  Payload ID: 16947
  Gene Symbol: SMN2
  Gene Name: survival of motor neuron 2, centromeric
  Uniprot ID: Q16637
  ENSP ID: ENSP00000485595

SEQ ID NO: 85281 - protein, 79 aa, Homo sapiens; identical to SEQ ID NO: 85250
  Payload ID: 16947
  Gene Symbol: SMN2
  Gene Name: survival of motor neuron 2, centromeric
  ENSP ID: ENSP00000485777

SEQ ID NO: 85282 - protein, 294 aa, Homo sapiens; identical to SEQ ID NO: 85246
  Payload ID: 16947
  Gene Symbol: SMN2
  Gene Name: survival of motor neuron 2, centromeric
  ENSP ID: ENSP00000485830

SEQ ID NO: 85283 - protein, 294 aa, Homo sapiens; identical to SEQ ID NO: 85246
  Payload ID: 16947
  Gene Symbol: SMN2
  Gene Name: survival of motor neuron 2, centromeric
  ENSP ID: ENSP00000486030

SEQ ID NO: 85284 - protein, 282 aa, Homo sapiens; identical to SEQ ID NO: 85248
  Payload ID: 16947
  Gene Symbol: SMN2
  Gene Name: survival of motor neuron 2, centromeric
  Uniprot ID: Q16637
  ENSP ID: ENSP00000486152

SEQ ID NO: 85285 - protein, 294 aa, Homo sapiens; identical to SEQ ID NO: 85246
  Payload ID: 16947
  Gene Symbol: SMN2
  Gene Name: survival of motor neuron 2, centromeric
  ENSP ID: ENSP00000486268

SEQ ID NO: 85286 - protein, 227 aa, Homo sapiens; identical to SEQ ID NO: 85247
  Payload ID: 16947
  Gene Symbol: SMN2
  Gene Name: survival of motor neuron 2, centromeric
  ENSP ID: ENSP00000486922

SEQ ID NO: 85287 - protein, 282 aa, Homo sapiens; identical to SEQ ID NO: 85248
  Payload ID: 16947
  Gene Symbol: SMN2
  Gene Name: survival of motor neuron 2, centromeric
  Uniprot ID: Q16637
  ENSP ID: ENSP00000487015

SEQ ID NO: 85288 - protein, 294 aa, Homo sapiens; identical to SEQ ID NO: 85244
  Payload ID: 16947
  Gene Symbol: SMN2
  Gene Name: survival of motor neuron 2, centromeric
  Uniprot ID: Q16637
  ENSP ID: ENSP00000487421

SEQ ID NO: 85289 - protein, 706 aa, Homo sapiens
  Payload ID: 16948
  Gene Symbol: SUSD1
  Gene Name: sushi domain containing 1
  ENSP ID: ENSP00000347558
  MOD_RES (1)..(1): Any amino acid
XLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKIRHSCCCRWRVLDWVPWLL

SEQ ID NO: 85290 - protein, 722 aa, Homo sapiens
  Payload ID: 16948
  Gene Symbol: SUSD1
  Gene Name: sushi domain containing 1
  ENSP ID: ENSP00000363381
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKIRHSCCCRWRVLDWVPWLL

SEQ ID NO: 85291 - protein, 757 aa, Homo sapiens
  Payload ID: 16948
  Gene Symbol: SUSD1
  Gene Name: sushi domain containing 1
  Uniprot ID: Q6UWL2
  ENSP ID: ENSP00000363382
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKEIPCNCNFLRLHIHRANSGDTQIRHSCCCRWRVLDWVPWLL

SEQ ID NO: 85292 - protein, 747 aa, Homo sapiens
  Payload ID: 16948
  Gene Symbol: SUSD1
  Gene Name: sushi domain containing 1
  Uniprot ID: Q6UWL2
  ENSP ID: ENSP00000363388
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKDSSLMLLQMAGVGLGSLAVVIILTFLSFSAV

SEQ ID NO: 85293 - protein, 281 aa, Homo sapiens
  Payload ID: 16948
  Gene Symbol: SUSD1
  Gene Name: sushi domain containing 1
  ENSP ID: ENSP00000404269
  MOD_RES (1)..(1): Any amino acid
XGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAGSRNSHGRNTHIKEVDLLEDDGSFNISIFNETCLKLNRRSRKVGSEHMYQFTVLGQRWYLANFSHATSFNFTTREQV

SEQ ID NO: 85294 - protein, 45 aa, Homo sapiens
  Payload ID: 16948
  Gene Symbol: SUSD1
  Gene Name: sushi domain containing 1
  ENSP ID: ENSP00000431590
VITALYYESQVNGISIKFILMRSVYIIVTGDQNPIHTTLSKELHS

SEQ ID NO: 85295 - protein, 822 aa, Homo sapiens
  Payload ID: 16949
  Gene Symbol: SUSD2
  Gene Name: sushi domain containing 2
  Uniprot ID: Q9UGT4
  ENSP ID: ENSP00000351075
MKPALLPWALLLLATALGPGPGPTADAQESCSMRCGALDGPCSCHPTCSGLGTCCLDFRDFCLEILPYSGSMMGGKDFVVRHFKMSSPTDASVICRFKDSIQTLGHVDSSGQVHCVSPLLYESGRIPFTVSLDNGHSFPRAGTWLAVHPNKVSMMEKSELVNETRWQYYGTANTSGNLSLTWHVKSLPTQTITIELWGYEETGMPYSQEWTAKWSYLYPLATHIPNSGSFTFTPKPAPPSYQRWRVGALRIIDSKNYAGQKDVQALWTNDHALAWHLSDDFREDPVAWARTQCQAWEELEDQLPNFLEELPDCPCTLTQARADSGRFFTDYGCDMEQGSVCTYHPGAVHCVRSVQASLRYGSGQQCCYTADGTQLLTADSSGGSTPDRGHDWGAPPFRTPPRVPSMSHWLYDVLSFYYCCLWAPDCPRYMQRRPSNDCRNYRPPRLASAFGDPHFVTFDGTNFTFNGRGEYVLLEAALTDLRVQARAQPGTMSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHNASSLLTYDSWFLVHNFLYQPKHDPTFEPLFPSETTLNPSLAQEAAKLCGDDHFCNFDVAATGSLSTGTATRVAHQLHQRRMQSLQPVVSCGWLAPPPNGQKEGNRYLAGSTIYFHCDNGYSLAGAETSTCQADGTWSSPTPKCQPGRSYAVLLGIIFGGLAVVAAVALVYVLLRRRKGNTHVWGAQP

SEQ ID NO: 85296 - protein, 242 aa, Homo sapiens
  Payload ID: 16950
  Gene Symbol: SUSD3
  Gene Name: sushi domain containing 3
  Uniprot ID: Q96L08
  ENSP ID: ENSP00000364618
MKNIGLVMEWEIPEIICTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 85297 - protein, 255 aa, Homo sapiens
  Payload ID: 16950
  Gene Symbol: SUSD3
  Gene Name: sushi domain containing 3
  Uniprot ID: Q96L08
  ENSP ID: ENSP00000364621
MRWAAATLRGKARPRGRAGVTTPAPGNRTGTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 85298 - protein, 119 aa, Homo sapiens
  Payload ID: 16950
  Gene Symbol: SUSD3
  Gene Name: sushi domain containing 3
  ENSP ID: ENSP00000474695
  MOD_RES (1)..(1): Any amino acid
XVPPHETFGFKVAVIASIVSCAIILLMSMAFLTCCLLKCVKKSKRRRSNRDHGESTSKLASVTRSVDKDPGIPRALSLSGSSSSPQAQVMVHMANPRQPLPASGLATGMPQQPAAYALG

SEQ ID NO: 85299 - protein, 154 aa, Homo sapiens
  Payload ID: 16950
  Gene Symbol: SUSD3
  Gene Name: sushi domain containing 3
  ENSP ID: ENSP00000475051
RPRGRAGVTTPAPGNRTVVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHM

SEQ ID NO: 85300 - protein, 211 aa, Homo sapiens
  Payload ID: 16950
  Gene Symbol: SUSD3
  Gene Name: sushi domain containing 3
  ENSP ID: ENSP00000479555
MRWAAATLRGKARPRGRAGVTTPAPGNRTGTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRDHGESTSKLASVTRSVDKDPGIPRALSLSGSSSSPQAQVMVHMANPRQPLPASGLATGMPQQPAAYALG

SEQ ID NO: 85301 - protein, 290 aa, Homo sapiens
  Payload ID: 16951
  Gene Symbol: SUSD4
  Gene Name: sushi domain containing 4
  Uniprot ID: Q5VX71
  ENSP ID: ENSP00000339926
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEGGRPEHLFPVLYFPHIRLAAAVLYFCPVLKSSPTPAPTCSSTSTTTSLF

SEQ ID NO: 85302 - protein, 490 aa, Homo sapiens
  Payload ID: 16951
  Gene Symbol: SUSD4
  Gene Name: sushi domain containing 4
  Uniprot ID: Q5VX71
  ENSP ID: ENSP00000344219
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 85303 - protein, 490 aa, Homo sapiens; identical to SEQ ID NO: 85302
  Payload ID: 16951
  Gene Symbol: SUSD4
  Gene Name: sushi domain containing 4
  Uniprot ID: Q5VX71
  ENSP ID: ENSP00000355843

SEQ ID NO: 85304 - protein, 488 aa, Homo sapiens
  Payload ID: 16951
  Gene Symbol: SUSD4
  Gene Name: sushi domain containing 4
  ENSP ID: ENSP00000476954
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGSHHAHWVLFLRN

SEQ ID NO: 85305 - protein, 421 aa, Homo sapiens
  Payload ID: 16951
  Gene Symbol: SUSD4
  Gene Name: sushi domain containing 4
  ENSP ID: ENSP00000477374
MYHGMNPSNGDGFLEQQQQQQQPQSPQRLLAVILWFQLALCFGPAQLTGDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEAQVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 85306 - protein, 463 aa, Homo sapiens
  Payload ID: 16951
  Gene Symbol: SUSD4
  Gene Name: sushi domain containing 4
  ENSP ID: ENSP00000477432
  MOD_RES (1)..(1): Any amino acid
XAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEAQVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 85307 - protein, 629 aa, Homo sapiens
  Payload ID: 16952
  Gene Symbol: SUSD5
  Gene Name: sushi domain containing 5
  Uniprot ID: O60279
  ENSP ID: ENSP00000308727
MTAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTEGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 85308 - protein, 243 aa, Homo sapiens
  Payload ID: 16952
  Gene Symbol: SUSD5
  Gene Name: sushi domain containing 5
  ENSP ID: ENSP00000406475
  MOD_RES (1)..(1): Any amino acid
XAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLE

SEQ ID NO: 85309 - protein, 303 aa, Homo sapiens
  Payload ID: 16953
  Gene Symbol: SUSD6
  Gene Name: sushi domain containing 6
  Uniprot ID: Q92537
  ENSP ID: ENSP00000344424
MCHGRIAPKSTSVFAVASVGHGVFLPLVILCTLLGDGLASVCPLPPEPENGGYICHPRPCRDPLTAGSVIEYLCAEGYMLKGDYKYLTCKNGEWKPAMEISCRLNEDKDTHTSLGVPTLSIVASTASSVALILLLVVLFVLLQPKLKSFHHSRRDQGVSGDQVSIMVDGVQVALPSYEEAVYGSSGHCVPPADPRVQIVLSEGSGPSGRSVPREQQLPDQGACSSAGGEDEAPGQSGLCEAWGSRASETVMVHQATTSSWVAGSGNRQLAHKETADSENSDIQSLLSLTSEEYTDDIPLLKEA

SEQ ID NO: 85310 - protein, 1413 aa, Homo sapiens
  Payload ID: 16954
  Gene Symbol: SNED1
  Gene Name: sushi, nidogen and EGF-like domains 1
  Uniprot ID: Q8TER0
  ENSP ID: ENSP00000308893
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGNVPGNCSENPCQNGGTCVPGADAHSCDCGPGFKGRRCELACIKVSRPCTRLFSETKAFPVWEGGVCHHVYKRVYRVHQDICFKESCESTSLKKTPNRKQSKSQTLEKS

SEQ ID NO: 85311 - protein, 599 aa, Homo sapiens
  Payload ID: 16954
  Gene Symbol: SNED1
  Gene Name: sushi, nidogen and EGF-like domains 1
  ENSP ID: ENSP00000342992
MHGILGACGRLRLEPATPLTPLLCAERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVYKRVYRVHQDICFKESCESTSLK

SEQ ID NO: 85312 - protein, 300 aa, Homo sapiens
  Payload ID: 16954
  Gene Symbol: SNED1
  Gene Name: sushi, nidogen and EGF-like domains 1
  ENSP ID: ENSP00000384789
  MOD_RES (1)..(1): Any amino acid
XSLPHVSDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYH

SEQ ID NO: 85313 - protein, 1324 aa, Homo sapiens
  Payload ID: 16954
  Gene Symbol: SNED1
  Gene Name: sushi, nidogen and EGF-like domains 1
  Uniprot ID: Q8TER0
  ENSP ID: ENSP00000384871
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGSESAALVGTLGLTDCSQGP

SEQ ID NO: 85314 - protein, 1352 aa, Homo sapiens
  Payload ID: 16954
  Gene Symbol: SNED1
  Gene Name: sushi, nidogen and EGF-like domains 1
  Uniprot ID: Q8TER0
  ENSP ID: ENSP00000386007
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVKQSKSQTLEKS

SEQ ID NO: 85315 - protein, 66 aa, Homo sapiens
  Payload ID: 16954
  Gene Symbol: SNED1
  Gene Name: sushi, nidogen and EGF-like domains 1
  ENSP ID: ENSP00000394324
QCQVENGSAVCVCQAGYTGAACEMDVDDCSPDPCLNGGSCVDLVGNYTCLCAEPFKGLRCETVVTC

SEQ ID NO: 85316 - protein, 272 aa, Homo sapiens
  Payload ID: 16954
  Gene Symbol: SNED1
  Gene Name: sushi, nidogen and EGF-like domains 1
  ENSP ID: ENSP00000401865
  MOD_RES (1)..(1): Any amino acid
XPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKGMAGRGVRAGVSTLESARGPPSCFSAVSLLVSRIAD

SEQ ID NO: 85317 - protein, 868 aa, Homo sapiens
  Payload ID: 16955
  Gene Symbol: SVEP1
  Gene Name: sushi, von Willebrand factor type A, EGF and pentraxin domain containing 1
  Uniprot ID: Q4LDE5
  ENSP ID: ENSP00000363585
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGN

SEQ ID NO: 85318 - protein, 3571 aa, Homo sapiens
  Payload ID: 16955
  Gene Symbol: SVEP1
  Gene Name: sushi, von Willebrand factor type A, EGF and pentraxin domain containing 1
  Uniprot ID: Q4LDE5
  ENSP ID: ENSP00000363593
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 85319 - protein, 3574 aa, Homo sapiens
  Payload ID: 16955
  Gene Symbol: SVEP1
  Gene Name: sushi, von Willebrand factor type A, EGF and pentraxin domain containing 1
  ENSP ID: ENSP00000384917
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGMLGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 85320 - protein, 464 aa, Homo sapiens
  Payload ID: 16956
  Gene Symbol: SRPX
  Gene Name: sushi-repeat containing protein, X-linked
  Uniprot ID: P78539
  ENSP ID: ENSP00000367794
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 85321 - protein, 405 aa, Homo sapiens
  Payload ID: 16956
  Gene Symbol: SRPX
  Gene Name: sushi-repeat containing protein, X-linked
  Uniprot ID: P78539
  ENSP ID: ENSP00000411165
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKHMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 85322 - protein, 444 aa, Homo sapiens
  Payload ID: 16956
  Gene Symbol: SRPX
  Gene Name: sushi-repeat containing protein, X-linked
  Uniprot ID: P78539
  ENSP ID: ENSP00000440758
MGSPAHRPALLLLLPPLLLLLLLRVPPSRSFPDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 85323 - protein, 379 aa, Homo sapiens
  Payload ID: 16956
  Gene Symbol: SRPX
  Gene Name: sushi-repeat containing protein, X-linked
  Uniprot ID: P78539
  ENSP ID: ENSP00000445034
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQAVAANPTLLLQYGASG

SEQ ID NO: 85324 - protein, 465 aa, Homo sapiens
  Payload ID: 16957
  Gene Symbol: SRPX2
  Gene Name: sushi-repeat containing protein, X-linked 2
  Uniprot ID: O60687
  ENSP ID: ENSP00000362095
MASQLTQRGALFLLFFLTPAVTPTWYAGSGYYPDESYNEVYAEEVPQAPALDYRVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLRGPEPGSHFPEGEHVIRYTAYDRAYNRASCKFIVKVQVRRCPTLKPPQHGYLTCTSAGDNYGATCEYHCDGGYDRQGTPSRVCQSSRQWSGSPPICAPMKINVNVNSAAGLLDQFYEKQRLLIISAPDPSNRYYKMQISMLQQSTCGLDLRHVTIIELVGQPPQEVGRIREQQLSANIIEELRQFQRLTRSYFNMVLIDKQGIDRDRYMEPVTPEEIFTFIDDYLLSNQELTQRREQRDICE

SEQ ID NO: 85325 - protein, 786 aa, Homo sapiens
  Payload ID: 16958
  Gene Symbol: SUPV3L1
  Gene Name: SUV3-like helicase
  Uniprot ID: Q8IYB8
  ENSP ID: ENSP00000352678
MSFSRALLWARLPAGRQAGHRAAICSALRPHFGPFPGVLGQVSVLATASSSASGGSKIPNTSLFVPLTVKPQGPSADGDVGAELTRPLDKNEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 85326 - protein, 263 aa, Homo sapiens
  Payload ID: 16958
  Gene Symbol: SUPV3L1
  Gene Name: SUV3-like helicase
  ENSP ID: ENSP00000409072
MSFSRALLWARLPAGRQAGHRAAICSALRPHFGPFPGVLGQVSVLATASSSASGGSKIPNTSLFVPLTVKPQGPSADGDVGAELTRPLDKNEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELE

SEQ ID NO: 85327 - protein, 152 aa, Homo sapiens
  Payload ID: 16959
  Gene Symbol: SZRD1
  Gene Name: SUZ RNA binding domain containing 1
  Uniprot ID: Q7Z422
  ENSP ID: ENSP00000383866
MEDEEVAESWEEAADSGEIDRRLEKKLKITQKESRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 85328 - protein, 133 aa, Homo sapiens
  Payload ID: 16959
  Gene Symbol: SZRD1
  Gene Name: SUZ RNA binding domain containing 1
  Uniprot ID: Q7Z422
  ENSP ID: ENSP00000383867
MRRSLRAGKRRQTAGRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 85329 - protein, 132 aa, Homo sapiens
  Payload ID: 16959
  Gene Symbol: SZRD1
  Gene Name: SUZ RNA binding domain containing 1
  Uniprot ID: Q7Z422
  ENSP ID: ENSP00000418012
MRRSLRAGKRRQTAGKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 85330 - protein, 151 aa, Homo sapiens
  Payload ID: 16959
  Gene Symbol: SZRD1
  Gene Name: SUZ RNA binding domain containing 1
  Uniprot ID: Q7Z422
  ENSP ID: ENSP00000419589
MEDEEVAESWEEAADSGEIDRRLEKKLKITQKERKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 85331 - protein, 84 aa, Homo sapiens
  Payload ID: 16959
  Gene Symbol: SZRD1
  Gene Name: SUZ RNA binding domain containing 1
  ENSP ID: ENSP00000420441
MRRSLRAGKRRQTAGSGPVCQSLLAVIRQGKCSLVPCSPFTSPGMLRASGVWLLAWSMKAFGLNPQRLLNSTAVKALFMMEKLE

SEQ ID NO: 85332 - protein, 739 aa, Homo sapiens
  Payload ID: 16960
  Gene Symbol: SUZ12
  Gene Name: SUZ12 polycomb repressive complex 2 subunit
  Uniprot ID: Q15022
  ENSP ID: ENSP00000316578
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKL

SEQ ID NO: 85333 - protein, 716 aa, Homo sapiens
  Payload ID: 16960
  Gene Symbol: SUZ12
  Gene Name: SUZ12 polycomb repressive complex 2 subunit
  ENSP ID: ENSP00000463936
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKL

SEQ ID NO: 85334 - protein, 155 aa, Homo sapiens
  Payload ID: 16961
  Gene Symbol: SVOP
  Gene Name: SV2 related protein
  ENSP ID: ENSP00000447275
MEEDLFQLRQLPVVKFRRTGESARSEDDTASGEHEVQIEGVHVGLEAVELDDGAAVPKEFANPTDDTFMVEDAVEAIGFGKFQWKLSVLTGLAWVVFVGMMSSSTLWGNISDQYGRKTGLKISVLWTLYYGILSAFAPVYSWILVLRGLVGFGIG

SEQ ID NO: 85335 - protein, 104 aa, Homo sapiens
  Payload ID: 16961
  Gene Symbol: SVOP
  Gene Name: SV2 related protein
  ENSP ID: ENSP00000447583
MEEDLFQLRQLPVVKFRRTGESARSEDDTASGEHEVQIEGVHVGLEAVELDDGAAVPKEFANPTDGGLCRHDVQLHALGKYLRPVRQENRAEDQRAVDSVLWHP

SEQ ID NO: 85336 - protein, 548 aa, Homo sapiens
  Payload ID: 16961
  Gene Symbol: SVOP
  Gene Name: SV2 related protein
  Uniprot ID: Q8N4V2
  ENSP ID: ENSP00000479104
MEEDLFQLRQLPVVKFRRTGESARSEDDTASGEHEVQIEGVHVGLEAVELDDGAAVPKEFANPTDDTFMVEDAVEAIGFGKFQWKLSVLTGLAWMADAMEMMILSILAPQLHCEWRLPSWQVALLTSVVFVGMMSSSTLWGNISDQYGRKTGLKISVLWTLYYGILSAFAPVYSWILVLRGLVGFGIGGVPQSVTLYAEFLPMKARAKCILLIEVFWAIGTVFEVVLAVFVMPSLGWRWLLILSAVPLLLFAVLCFWLPESARYDVLSGNQEKAIATLKRIATENGAPMPLGKLIISRQEDRGKMRDLFTPHFRWTTLLLWFIWFSNAFSYYGLVLLTTELFQAGDVCGISSRKKAVEAKCSLACEYLSEEDYMDLLWTTLSEFPGVLVTLWIIDRLGRKKTMALCFVIFSFCSLLLFICVGRNVLTLLLFIARAFISGGFQAAYVYTPEVYPTATRALGLGTCSGMARVGALITPFIAQVMLESSVYLTLAVYSGCCLLAALASCFLPIETKGRGLQESSHREWGQEMVGRGMHGAGVTRSNSGSQE

SEQ ID NO: 85337 - protein, 340 aa, Homo sapiens
  Payload ID: 16962
  Gene Symbol: SVOPL
  Gene Name: SVOP-like
  Uniprot ID: Q8N434
  ENSP ID: ENSP00000288513
MAAGRLIIKTEFLPTKYRGYMLPLSQVFWLAGSLLIIGLASVIIPTIGWRWLIRVASIPGIILIVAFKFIPESARFNVSTGNTRAALATLERVAKMNRSVMPEGKLVEPVLEKRGRFADLLDAKYLRTTLQIWVIWLGISFAYYGVILASAELLERDLVCGSKSDSAVVVTGGDSGESQSPCYCHMFAPSDYRTMIISTIGEIALNPLNILGINFLGRRLSLSITMGCTALFFLLLNICTSSAGLIGFLFMLRALVAANFNTVYIYTAEVYPTTMRALGMGTSGSLCRIGAMVAPFISQVLMSASILGALCLFSSVCVVCAISAFTLPIETKGRALQQIK

SEQ ID NO: 85338 - protein, 233 aa, Homo sapiens
  Payload ID: 16962
  Gene Symbol: SVOPL
  Gene Name: SVOP-like
  ENSP ID: ENSP00000393487
MNRSVMPEGKLVEPVLEKRGRFADLLDAKYLRTTLQIWVIWLGISFAYYGVILASAELLERDLVCGSKSDSAVVVTGGDSGESQSPCYCHMFAPSDYRTMIISTIGEIALNPLNILGINFLGRRLSLSITMGCTALFFLLLNICTSSAGLIGFLFMLRALVAANFNTVYIYTAEVYPTTMRALGMGTSGSLCRIGAMVAPFISQRALLLVNHFILYCRCEINGELSRTQTKRN

SEQ ID NO: 85339 - protein, 492 aa, Homo sapiens
  Payload ID: 16962
  Gene Symbol: SVOPL
  Gene Name: SVOP-like
  Uniprot ID: Q8N434
  ENSP ID: ENSP00000405482
MATKPTEPVTILSLRKLSLGTAEPQVKEPKTFTVEDAVETIGFGRFHIALFLIMGSTGVVEAMEIMLIAVVSPVIRCEWQLENWQVALVTTMVFFGYMVFSILFGLLADRYGRWKILLISFLWGAYFSLLTSFAPSYIWFVFLRTMVGCGVSGHSQGLIIKTEFLPTKYRGYMLPLSQVFWLAGSLLIIGLASVIIPTIGWRWLIRVASIPGIILIVAFKFIPESARFNVSTGNTRAALATLERVAKMNRSVMPEGKLVEPVLEKRGRFADLLDAKYLRTTLQIWVIWLGISFAYYGVILASAELLERDLVCGSKSDSAVVVTGGDSGESQSPCYCHMFAPSDYRTMIISTIGEIALNPLNILGINFLGRRLSLSITMGCTALFFLLLNICTSSAGLIGFLFMLRALVAANFNTVYIYTAEVYPTTMRALGMGTSGSLCRIGAMVAPFISQVLMSASILGALCLFSSVCVVCAISAFTLPIETKGRALQQIK

SEQ ID NO: 85340 - protein, 372 aa, Homo sapiens
  Payload ID: 16962
  Gene Symbol: SVOPL
  Gene Name: SVOP-like
  ENSP ID: ENSP00000412830
MATKPTEPVTILSLRKLSLGTAEPQVKEPKTFTVEDAVETIGFGRFHIALFLIMGSTGVFWLAGSLLIIGLASVIIPTIGWRWLIRVASIPGIILIVAFKFIPESARFNVSTGNTRAALATLERVAKMNRSVMPEGKLVEPVLEKRGRFADLLDAKYLRTTLQIWVIWLGISFAYYGVILASAELLERDLVCGSKSDSAVVVTGGDSGESQSPCYCHMFAPSDYRTMIISTIGEIALNPLNILGINFLGRRLSLSITMGCTALFFLLLNICTSSAGLIGFLFMLRALVAANFNTVYIYTAEVYPTTMRALGMGTSGSLCRIGAMVAPFISQVLMSASILGALCLFSSVCVVCAISAFTLPIETKGRALQQIK

SEQ ID NO: 85341 - protein, 340 aa, Homo sapiens; identical to SEQ ID NO: 85337
  Payload ID: 16962
  Gene Symbol: SVOPL
  Gene Name: SVOP-like
  Uniprot ID: Q8N434
  ENSP ID: ENSP00000417018

SEQ ID NO: 85342 - protein, 585 aa, Homo sapiens
  Payload ID: 16963
  Gene Symbol: SWAP70
  Gene Name: SWAP switching B-cell complex 70kDa subunit
  Uniprot ID: Q9UH65
  ENSP ID: ENSP00000315630
MGSLKEELLKAIWHAFTALDQDHSGKVSKSQLKVLSHNLCTVLKVPHDPVALEEHFRDDDEGPVSNQGYMPYLNRFILEKVQDNFDKIEFNRMCWTLCVKKNLTKNPLLITEEDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEQLELERKQALEQYEEVKKKLEMATNKTKSWKDKVAHHEGLIRLIEPGSKNPHLITNWGPAAFTEAELEEREKNWKEKKTTE

SEQ ID NO: 85343 - protein, 527 aa, Homo sapiens
  Payload ID: 16963
  Gene Symbol: SWAP70
  Gene Name: SWAP switching B-cell complex 70kDa subunit
  ENSP ID: ENSP00000399056
MGSLKEELLKAIWHAFTALDQDHSGKVSKSQLKVLSHNLCTVLKVPHDPVALEEHFRDDDEGPVSNQGYMPYLNRFILEKIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEQLELERKQALEQYEEVKKKLEMATNKTKSWKDKVAHHEGLIRLIEPGSKNPHLITNWGPAAFTEAELEEREKNWKEKKTTE

SEQ ID NO: 85344 - protein, 149 aa, Homo sapiens
  Payload ID: 16963
  Gene Symbol: SWAP70
  Gene Name: SWAP switching B-cell complex 70kDa subunit
  ENSP ID: ENSP00000431768
MGSLKEELLKAIWHAFTALDQDHSGKVSKSQLKVLSHNLCTVLKVPHDPVALEEHFRDDDEGPVSNQGYMPYLNRFILEKITKTLPASEPSDMLLPVLSKTTLTRLNSIGCVGPSVSKKTSQRIPCSLQKKMHLKYGLFSTFYLRTSIH

SEQ ID NO: 85345 - protein, 23 aa, Homo sapiens
  Payload ID: 16963
  Gene Symbol: SWAP70
  Gene Name: SWAP switching B-cell complex 70kDa subunit
  ENSP ID: ENSP00000433824
  MOD_RES (1)..(1): Any amino acid
XFPVGLGQSSSFRILRGQAERVT

SEQ ID NO: 85346 - protein, 226 aa, Homo sapiens
  Payload ID: 16963
  Gene Symbol: SWAP70
  Gene Name: SWAP switching B-cell complex 70kDa subunit
  ENSP ID: ENSP00000435587
MGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKK

SEQ ID NO: 85347 - protein, 1070 aa, Homo sapiens
  Payload ID: 16964
  Gene Symbol: SMARCA1
  Gene Name: SWI/SNF related, matrix associated, actin dependent regulator of chromatin, subfamily a, member 1
  ENSP ID: ENSP00000360162
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMSQKRKAESATESSGKKDVKKVKS

SEQ ID NO: 85348 - protein, 1054 aa, Homo sapiens
  Payload ID: 16964
  Gene Symbol: SMARCA1
  Gene Name: SWI/SNF related, matrix associated, actin dependent regulator of chromatin, subfamily a, member 1
  Uniprot ID: P28370
  ENSP ID: ENSP00000360163
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 85349 - protein, 1058 aa, Homo sapiens
  Payload ID: 16964
  Gene Symbol: SMARCA1
  Gene Name: SWI/SNF related, matrix associated, actin dependent regulator of chromatin, subfamily a, member 1
  ENSP ID: ENSP00000360164
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREEAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMSQKRKAESATESSGKKDVKKVKS

SEQ ID NO: 85350 - protein, 1590 aa, Homo sapiens
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENSP ID: ENSP00000265773
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85351 - protein, 278 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000305411
MLMKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85352 - protein, 248 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000324770
MWLAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85353 - protein, 1572 aa, Homo sapiens
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENSP ID: ENSP00000349788
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85354 - protein, 236 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000371618
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85355 - protein, 276 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000371620
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85356 - protein, 254 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000371621
MEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85357 - protein, 1572 aa, Homo sapiens; identical to SEQ ID NO: 85353
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENSP ID: ENSP00000371629

SEQ ID NO: 85358 - protein, 1590 aa, Homo sapiens; identical to SEQ ID NO: 85350
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENSP ID: ENSP00000371638

SEQ ID NO: 85359 - protein, 276 aa, Homo sapiens; identical to SEQ ID NO: 85355
  Payload ID: 16965
  Gene Symbol: SMARCA2
  Gene Name: SWI/SNF related, matrix associated, actin dependent regulator of chromatin, subfamily a, member 2
  ENSP ID: ENSP00000387486

SEQ ID NO: 85360 - protein, 1514 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000392081
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85361 - protein, 182 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000401096
MWLAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKI

SEQ ID NO: 85362 - protein, 215 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000409398
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGL

SEQ ID NO: 85363 - protein, 192 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000412242
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDD

SEQ ID NO: 85364 - protein, 228 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000413057
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLN

SEQ ID NO: 85365 - protein, 193 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000415218
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLA

SEQ ID NO: 85366 - protein, 228 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000488947
  MOD_RES (1)..(1): Any amino acid
XNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKVDLNEEETILIIRRLHKVLRPFLLRRLKKEVESQLPEKVEYVIKCDMSA

SEQ ID NO: 85367 - protein, 98 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489100
MKRLAARCFAGLLILSPLTVISDSRPADSGKCCWLWFKASVCRPSKTAIWRKWKRKYGLRSEKDEEMWIKILQKKMWKKLRREEAALPLRNCHQIPPN

SEQ ID NO: 85368 - protein, 62 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489142
MKGTGMRPPHPGMGPPQSPMDQHSQGYMSPHPSPLGAPEHVSSPMSGGGPTPPQMPPSQPGA

SEQ ID NO: 85369 - protein, 200 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489168
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESED

SEQ ID NO: 85370 - protein, 229 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489204
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNK

SEQ ID NO: 85371 - protein, 245 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489212
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKL

SEQ ID NO: 85372 - protein, 1428 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489256
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNRKGFVIISTGA

SEQ ID NO: 85373 - protein, 202 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489271
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKK

SEQ ID NO: 85374 - protein, 260 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489302
MIINISHVWCCGEMKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 85375 - protein, 58 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489334
  MOD_RES (1)..(1): Any amino acid
XPFPSSLFFPDQLMKRLAARCFAGLLILSPLTVISDSRPADSGHRRRQFGGNGRGSTA

SEQ ID NO: 85376 - protein, 244 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489388
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIK

SEQ ID NO: 85377 - protein, 254 aa, Homo sapiens; identical to SEQ ID NO: 85356
  Payload ID: 16965
  Gene Symbol: SMARCA2
  Gene Name: SWI/SNF related, matrix associated, actin dependent regulator of chromatin, subfamily a, member 2
  ENSP ID: ENSP00000489433

SEQ ID NO: 85378 - protein, 149 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489473
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSAR

SEQ ID NO: 85379 - protein, 38 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489501
  MOD_RES (1)..(1): Any amino acid
XSGRQLSEVFIQLPSRKELPEYYELIRKPVDFKKIKDS

SEQ ID NO: 85380 - protein, 169 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489504
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEE

SEQ ID NO: 85381 - protein, 270 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489518
  MOD_RES (1)..(1): Any amino acid
XLNLQAADTVVIFDSDWNPHQEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVL

SEQ ID NO: 85382 - protein, 68 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489555
MAIEDGNLEEMEEEVRLKKRKRRRNVDKDPAKEDVEKAKKRRGRPPAEKLSPNPPKLTKQMNAIIDTV

SEQ ID NO: 85383 - protein, 57 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489560
AAAQPPAAAVPGPSVPQPAPGQPSPVLQLQQKQSRISPIQKPQGLDPVEILQEREYR

SEQ ID NO: 85384 - protein, 98 aa, Homo sapiens; identical to SEQ ID NO: 85367
  Payload ID: 16965
  Gene Symbol: SMARCA2
  Gene Name: SWI/SNF related, matrix associated, actin dependent regulator of chromatin, subfamily a, member 2
  ENSP ID: ENSP00000489587

SEQ ID NO: 85385 - protein, 231 aa, Homo sapiens
  Payload ID: 16965
  Gene Symbol: SMARCA2
  Gene Name: SWI/SNF related, matrix associated, actin dependent regulator of chromatin, subfamily a, member 2
  ENSP ID: ENSP00000489615
MKTQPFPSSLFFPDQLMKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESE

SEQ ID NO: 85386 - protein, 1647 aa, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENSP ID: ENSP00000343896
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 85387 - protein, 1613 aa, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENSP ID: ENSP00000392837
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 85388 - protein, 1647 aa, Homo sapiens; identical to SEQ ID NO: 85386
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENSP ID: ENSP00000395654

SEQ ID NO: 85389 - protein, 1679 aa, Homo sapiens
  Payload ID: 16966
  Gene Symbol: SMARCA4
  Gene Name: SWI/SNF related, matrix associated, actin dependent regulator of chromatin, subfamily a, member 4
  ENSP ID: ENSP00000397783
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKKITGKDIHDTASSVARGLQFQRGLQFCTRASKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 85390 - protein, 1681 aa, Homo sapiens [sequence omitted]

SEQ ID NO: 85391 - protein, 1617 aa, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENSP ID: ENSP00000445036
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 85392 - protein, 1616 aa, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENSP ID: ENSP00000464778
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 85393 - protein, 1614 aa, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENSP ID: ENSP00000466963
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 85394 - protein, 136 aa, Homo sapiens
  Payload ID: 16966
  Gene Symbol: SMARCA4
  Gene Name: SWI/SNF related, matrix associated, actin dependent regulator of chromatin, subfamily a, member 4
  ENSP ID: ENSP00000467200
TRAGGLGLNLQSADTVIIFDSDWNPHQDLQAQDRAHRIGQQNEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKR

SEQ ID NO: 85395 - protein, 113 aa, Homo sapiens
  Payload ID: 16966
  Gene Symbol: SMARCA4
  Gene Name: SWI/SNF related, matrix associated, actin dependent regulator of chromatin, subfamily a, member 4
  ENSP ID: ENSP00000467796
  MOD_RES (1)..(1): Any amino acid
XDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEAS

SEQ ID NO: 85396 - protein, 1052 aa, Homo sapiens
  Payload ID: 16967
  Gene Symbol: SMARCA5
  Gene Name: SWI/SNF related, matrix associated, actin dependent regulator of chromatin, subfamily a, member 5
  Uniprot ID: O60264
  ENSP ID: ENSP00000283131
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 85397 - protein, 954 aa, Homo sapiens
  Payload ID: 16968
  Gene Symbol: SMARCAL1
  Gene Name: SWI/SNF related, matrix associated, actin dependent regulator of chromatin, subfamily a-like 1
  Uniprot ID: Q9NZC9
  ENSP ID: ENSP00000349823
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVPEADLSEVDPKLVSNLMPFQRAGVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIDESHFLKNSRTARCRAAMPVLKVAKRVILLSGTPAMSRPAELYTQIIAVKPTFFPQFHAFGLRYCDAKRMPWGWDYSGSSNLGELKLLLEEAVMLRRLKSDVLSQLPAKQRKIVVIAPGRINARTRAALDAAAKEMTTKDKTKQQQKDALILFFNRTAEAKIPSVIEYILDLLESGREKFLVFAHHKVVLDAITQELERKHVQHIRIDGSTSSAEREDLCQQFQLSERHAVAVLSITAANMGLTFSSADLVVFAELFWNPGVLIQAEDRVHRIGQTSSVGIHYLVAKGTADDYLWPLIQEKIKVLAEAGLSETNFSEMTESTDYLYKDPKQQKIYDLFQKSFEKEGSDMELLEAAESFDPGSASGTSGSSSQNMGDTLDESSLTASPQKKRRFEFFDNWDSFTSPL

SEQ ID NO: 85398 - protein, 954 aa, Homo sapiens; identical to SEQ ID NO: 85397
  Payload ID: 16968
  Gene Symbol: SMARCAL1
  Gene Name: SWI/SNF related, matrix associated, actin dependent regulator of chromatin, subfamily a-like 1
  Uniprot ID: Q9NZC9
  ENSP ID: ENSP00000350940

SEQ ID NO: 85399 - protein, 796 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000375974
QLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVPEADLSEVDPKLVSNLMPFQRAGVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIVAKRVILLSGTPAMSRPAELYTQIIAVKPTFFPQFHAFGLRYCDAKRMPWGWDYSGSSNLGELKLLLEEAVMLRRLKSDVLSQLPAKQRKIVVIAPGRINARTRAALDAAAKEMTTKDKTKQQQKDALILFFNRTAEAKIPSVIEYILDLLESGREKFLVFAHHKVVLDAITQELERKHVQHIRIDGSTSSAEREDLCQQFQLSERHAVAVLSITAANMGLTFSSADLVVFAELFWNPGVLIQAEDRVHRIGQTSSVGIHYLVAKGTADDYLWPLIQEKIKVLAEAGLSETNFSEMTESTDYLYKDPKQQKIYDLFQKSFEKEGSDMELLEAAESFDPGSASGTSGSSSQNMGDTLDESSLTASPQKKRRFEFFDNWDSFTSPL

SEQ ID NO: 85400 - protein, 141 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000390248
MNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVP

SEQ ID NO: 85401 - protein, 325 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000392997
EEMPTACPGHSPRSQMALTGISPPLAQSPPEVPKQQLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYVAKVRCLPQVQLDPLPTTLTLAFASQLKKTSLSLTPDVPEADLSEVDPKLVSNLMPFQRAG

SEQ ID NO: 85402 - protein, 19 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000394410
MSLPLTEEQRKKIEENRQK

SEQ ID NO: 85403 - protein, 130 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000398969
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSP

SEQ ID NO: 85404 - protein, 161 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000400473
  MOD_RES (1)..(1): Any amino acid
XVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIDESHFLKNSRTARCRAAMPVLKHTVNIYWLLGVRHMLQKIKVAKRVILLSGTPAM

SEQ ID NO: 85405 - protein, 92 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000402967
MSLPLTEEQRKKIEENRQKALARRAEKLLAEQHQRTSSGTSIAGNPFQAKQGPSQNFPRESCKPVSHGVIFKQQNLSSSSNADQRPHDSHSF

SEQ ID NO: 85406 - protein, 145 aa, Homo sapiens
  Payload ID: 16968
  Gene Symbol: SMARCAL1
  Gene Name: SWI/SNF related, matrix associated, actin dependent regulator of chromatin, subfamily a-like 1
  ENSP ID: ENSP00000405077
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQ

SEQ ID NO: 85407 - protein, 385 aa, Homo sapiens
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENSP ID: ENSP00000263121
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 85408 - protein, 394 aa, Homo sapiens
  Payload ID: 16969
  Gene Symbol: SMARCB1
  Gene Name: SWI/SNF related, matrix associated, actin dependent regulator of chromatin, subfamily b, member 1
  ENSP ID: ENSP00000340883
MMMMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLHFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 85409 - protein, 376 aa, Homo sapiens
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENSP ID: ENSP00000383984
MMMMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 85410 - protein, 339 aa, Homo sapiens
  Payload ID: 16969
  Gene Symbol: SMARCB1
  Gene Name: SWI/SNF related, matrix associated, actin dependent regulator of chromatin, subfamily b, member 1
  ENSP ID: ENSP00000385226
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLSFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 85411 - protein, 227 aa, Homo sapiens
  Payload ID: 16969
  Gene Symbol: SMARCB1
  Gene Name: SWI/SNF related, matrix associated, actin dependent regulator of chromatin, subfamily b, member 1
  ENSP ID: ENSP00000388489
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLHFDDHDPAVIHENASQPEVLVPIRLDMEIDGQKLRDAFTWNMN

SEQ ID NO: 85412 - protein, 385 aa, Homo sapiens; identical to SEQ ID NO: 85407
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENSP ID: ENSP00000479330

SEQ ID NO: 85413 - protein, 394 aa, Homo sapiens; identical to SEQ ID NO: 85408
  Payload ID: 16969
  Gene Symbol: SMARCB1
  Gene Name: SWI/SNF related, matrix associated, actin dependent regulator of chromatin, subfamily b, member 1
  ENSP ID: ENSP00000486780

SEQ ID NO: 85414 - protein, 376 aa, Homo sapiens; identical to SEQ ID NO: 85409
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENSP ID: ENSP00000486870

SEQ ID NO: 85415 - protein, 339 aa, Homo sapiens; identical to SEQ ID NO: 85410
  Payload ID: 16969
  Gene Symbol: SMARCB1
  Gene Name: SWI/SNF related, matrix associated, actin dependent regulator of chromatin, subfamily b, member 1
  ENSP ID: ENSP00000487092

SEQ ID NO: 85416 - protein, 227 aa, Homo sapiens; identical to SEQ ID NO: 85411
  Payload ID: 16969
  Gene Symbol: SMARCB1
  Gene Name: SWI/SNF related, matrix associated, actin dependent regulator of chromatin, subfamily b, member 1
  ENSP ID: ENSP00000487582

SEQ ID NO: 85417 - protein, 81 aa, Homo sapiens
  Payload ID: 16969
  Gene Symbol: SMARCB1
  Gene Name: SWI/SNF related, matrix associated, actin dependent regulator of chromatin, subfamily b, member 1
  ENSP ID: ENSP00000489115
  MOD_RES (1)..(1): Any amino acid
XWRRLATVEERKKIVASSHDHGYTTLATSVTLLKASEVEEILDGNDEKYKAVSISTEPPTYLREQKAKRNSHFDDHDPAVI

SEQ ID NO: 85418 - protein, 90 aa, Homo sapiens
  Payload ID: 16969
  Gene Symbol: SMARCB1
  Gene Name: SWI/SNF related, matrix associated, actin dependent regulator of chromatin, subfamily b, member 1
  ENSP ID: ENSP00000489445
  MOD_RES (1)..(1): Any amino acid
XWRRLATVEERKKIVASSHGKKTKPNTKDHGYTTLATSVTLLKASEVEEILDGNDEKYKAVSISTEPPTYLREQKAKRNSHFDDHDPAVI

SEQ ID NO: 85419 - protein, 1105 aa, Homo sapiens
  Payload ID: 16970
  Gene Symbol: SMARCC1
  Gene Name: SWI/SNF related, matrix associated, actin dependent regulator of chromatin, subfamily c, member 1
  Uniprot ID: Q92922
  ENSP ID: ENSP00000254480
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 85420 - protein, 133 aa, Homo sapiens
  Payload ID: 16970
  Gene Symbol: SMARCC1
  Gene Name: SWI/SNF related, matrix associated, actin dependent regulator of chromatin, subfamily c, member 1
  ENSP ID: ENSP00000414266
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQG

SEQ ID NO: 85421 - protein, 1214 aa, Homo sapiens
  Payload ID: 16971
  Gene Symbol: SMARCC2
  Gene Name: SWI/SNF related, matrix associated, actin dependent regulator of chromatin, subfamily c, member 2
  Uniprot ID: Q8TAQ2
  ENSP ID: ENSP00000267064
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 85422 - protein, 1130 aa, Homo sapiens
  Payload ID: 16971
  Gene Symbol: SMARCC2
  Gene Name: SWI/SNF related, matrix associated, actin dependent regulator of chromatin, subfamily c, member 2
  Uniprot ID: Q8TAQ2
  ENSP ID: ENSP00000302919
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVADPGTPLPPDPTAPSPGTVTPVPPPQ

SEQ ID NO: 85423 - protein, 1152 aa, Homo sapiens
  Payload ID: 16971
  Gene Symbol: SMARCC2
  Gene Name: SWI/SNF related, matrix associated, actin dependent regulator of chromatin, subfamily c, member 2
  Uniprot ID: Q8TAQ2
  ENSP ID: ENSP00000377591
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAAQSPAIVAAVQGNLLPSASPLPDPGTPLPPDPTAPSPGTVTPVPPPQ

SEQ ID NO: 85424 - protein, 105 aa, Homo sapiens
  Payload ID: 16971
  Gene Symbol: SMARCC2
  Gene Name: SWI/SNF related, matrix associated, actin dependent regulator of chromatin, subfamily c, member 2
  ENSP ID: ENSP00000447680
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQG

SEQ ID NO: 85425 - protein, 1245 aa, Homo sapiens
  Payload ID: 16971
  Gene Symbol: SMARCC2
  Gene Name: SWI/SNF related, matrix associated, actin dependent regulator of chromatin, subfamily c, member 2
  ENSP ID: ENSP00000449396
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 85426 - protein, 105 aa, Homo sapiens; identical to SEQ ID NO: 85424
  Payload ID: 16971
  Gene Symbol: SMARCC2
  Gene Name: SWI/SNF related, matrix associated, actin dependent regulator of chromatin, subfamily c, member 2
  ENSP ID: ENSP00000449429

SEQ ID NO: 85427 - protein, 474 aa, Homo sapiens
  Payload ID: 16972
  Gene Symbol: SMARCD1
  Gene Name: SWI/SNF related, matrix associated, actin dependent regulator of chromatin, subfamily d, member 1
  Uniprot ID: Q96GM5
  ENSP ID: ENSP00000370924
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKTMTDVVGNPEEERRAEFYFQPWAQEAVCRYFYSKVQQRRQELEQALGIRNT

SEQ ID NO: 85428 - protein, 515 aa, Homo sapiens
  Payload ID: 16972
  Gene Symbol: SMARCD1
  Gene Name: SWI/SNF related, matrix associated, actin dependent regulator of chromatin, subfamily d, member 1
  Uniprot ID: Q96GM5
  ENSP ID: ENSP00000378414
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 85429 - protein, 278 aa, Homo sapiens
  Payload ID: 16972
  Gene Symbol: SMARCD1
  Gene Name: SWI/SNF related, matrix associated, actin dependent regulator of chromatin, subfamily d, member 1
  ENSP ID: ENSP00000447386
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQAL

SEQ ID NO: 85430 - protein, 115 aa, Homo sapiens
  Payload ID: 16972
  Gene Symbol: SMARCD1
  Gene Name: SWI/SNF related, matrix associated, actin dependent regulator of chromatin, subfamily d, member 1
  ENSP ID: ENSP00000447909
  MOD_RES (1)..(1): Any amino acid
XTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 85431 - protein, 289 aa, Homo sapiens
  Payload ID: 16972
  Gene Symbol: SMARCD1
  Gene Name: SWI/SNF related, matrix associated, actin dependent regulator of chromatin, subfamily d, member 1
  ENSP ID: ENSP00000448030
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPE

SEQ ID NO: 85432 - protein, 313 aa, Homo sapiens
  Payload ID: 16972
  Gene Symbol: SMARCD1
  Gene Name: SWI/SNF related, matrix associated, actin dependent regulator of chromatin, subfamily d, member 1
  ENSP ID: ENSP00000448627
MCNGLLNLPHFPWANEMALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 85433 - protein, 113 aa, Homo sapiens
  Payload ID: 16972
  Gene Symbol: SMARCD1
  Gene Name: SWI/SNF related, matrix associated, actin dependent regulator of chromatin, subfamily d, member 1
  ENSP ID: ENSP00000449825
MLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRP

SEQ ID NO: 85434 - protein, 456 aa, Homo sapiens
  Payload ID: 16973
  Gene Symbol: SMARCD2
  Gene Name: SWI/SNF related, matrix associated, actin dependent regulator of chromatin, subfamily d, member 2
  ENSP ID: ENSP00000225742
MSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 85435 - protein, 483 aa, Homo sapiens
  Payload ID: 16973
  Gene Symbol: SMARCD2
  Gene Name: SWI/SNF related, matrix associated, actin dependent regulator of chromatin, subfamily d, member 2
  Uniprot ID: Q92925
  ENSP ID: ENSP00000318451
MGRRVGVEVTPRWAPQKCQGARPQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 85436 - protein, 531 aa, Homo sapiens
  Payload ID: 16973
  Gene Symbol: SMARCD2
  Gene Name: SWI/SNF related, matrix associated, actin dependent regulator of chromatin, subfamily d, member 2
  Uniprot ID: Q92925
  ENSP ID: ENSP00000392617
MSGRGAGGFPLPPLSPGGGAVAAALGAPPPPAGPGMLPGPALRGPGPAGGVGGPGAAAFRPMGPAGPAAQYQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 85437 - protein, 231 aa, Homo sapiens
  Payload ID: 16973
  Gene Symbol: SMARCD2
  Gene Name: SWI/SNF related, matrix associated, actin dependent regulator of chromatin, subfamily d, member 2
  ENSP ID: ENSP00000398946
  MOD_RES (1)..(1): Any amino acid
XDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIITDVIGNPEEERRAAFYHQPWAQEAVGRHIFAKVQQRRQELEQVLGIRLT

SEQ ID NO: 85438 - protein, 69 aa, Homo sapiens
  Payload ID: 16973
  Gene Symbol: SMARCD2
  Gene Name: SWI/SNF related, matrix associated, actin dependent regulator of chromatin, subfamily d, member 2
  ENSP ID: ENSP00000462761
MSGRGAGGFPLPPLSPGGGAVAAALGAPPPPAGPGMLPGPALRGPGPAGGVGGPGAAAFRPMGPAGPAA

SEQ ID NO: 85439 - protein, 109 aa, Homo sapiens
  Payload ID: 16973
  Gene Symbol: SMARCD2
  Gene Name: SWI/SNF related, matrix associated, actin dependent regulator of chromatin, subfamily d, member 2
  ENSP ID: ENSP00000463793
RPGMSPGNRMPMAGLQVGPPAGSPFGAAAPLRPGMPPTMMDPFRKRLLVPQAQPPMPAQRRGLKRRKMADKVLPQRVSVKRTPGRPAQWPPWDPGACSRVSGVHGSLGF

SEQ ID NO: 85440 - protein, 80 aa, Homo sapiens
  Payload ID: 16973
  Gene Symbol: SMARCD2
  Gene Name: SWI/SNF related, matrix associated, actin dependent regulator of chromatin, subfamily d, member 2
  ENSP ID: ENSP00000464503
MSGRGAGGFPLPPLSPGGGAVAAALGAPPPPAGPGMLPGPALRGPGPAGGVGGPGAAAFRPMGPAGPAAQYQVKEEEDGR

SEQ ID NO: 85441 - protein, 494 aa, Homo sapiens
  Payload ID: 16973
  Gene Symbol: SMARCD2
  Gene Name: SWI/SNF related, matrix associated, actin dependent regulator of chromatin, subfamily d, member 2
  ENSP ID: ENSP00000483605
MSGRGAGGFPLPPLSPGGGAAFRPMGPAGPAAQYQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 85442 - protein, 483 aa, Homo sapiens
  Payload ID: 16974
  Gene Symbol: SMARCD3
  Gene Name: SWI/SNF related, matrix associated, actin dependent regulator of chromatin, subfamily d, member 3
  Uniprot ID: Q6STE5
  ENSP ID: ENSP00000262188
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 85443 - protein, 470 aa, Homo sapiens
  Payload ID: 16974
  Gene Symbol: SMARCD3
  Gene Name: SWI/SNF related, matrix associated, actin dependent regulator of chromatin, subfamily d, member 3
  Uniprot ID: Q6STE5
  ENSP ID: ENSP00000349254
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 85444 - protein, 470 aa, Homo sapiens; identical to SEQ ID NO: 85443
  Payload ID: 16974
  Gene Symbol: SMARCD3
  Gene Name: SWI/SNF related, matrix associated, actin dependent regulator of chromatin, subfamily d, member 3
  Uniprot ID: Q6STE5
  ENSP ID: ENSP00000376558

SEQ ID NO: 85445 - protein, 68 aa, Homo sapiens
  Payload ID: 16974
  Gene Symbol: SMARCD3
  Gene Name: SWI/SNF related, matrix associated, actin dependent regulator of chromatin, subfamily d, member 3
  ENSP ID: ENSP00000417145
  MOD_RES (1)..(1): Any amino acid
XRHRARASRCPPPPRGAAVPRGGRWLTKSSLKGFGSWSPSPRLTWTSWHLRGNWIKPSCGSGWTSRRL

SEQ ID NO: 85446 - protein, 73 aa, Homo sapiens
  Payload ID: 16974
  Gene Symbol: SMARCD3
  Gene Name: SWI/SNF related, matrix associated, actin dependent regulator of chromatin, subfamily d, member 3
  ENSP ID: ENSP00000417908
MTLQVQDPAIYDSRSSAPTHRGTVPRGGRWLTKSSLKGFGSWSPSPRLTWTSWHLRGNWIKPSCGSGWTSRRL

SEQ ID NO: 85447 - protein, 139 aa, Homo sapiens
  Payload ID: 16974
  Gene Symbol: SMARCD3
  Gene Name: SWI/SNF related, matrix associated, actin dependent regulator of chromatin, subfamily d, member 3
  ENSP ID: ENSP00000419886
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMK

SEQ ID NO: 85448 - protein, 411 aa, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENSP ID: ENSP00000323967
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 85449 - protein, 328 aa, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENSP ID: ENSP00000367039
MSKRPSYAPPPTPAPATASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 85450 - protein, 157 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000392958
LSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 85451 - protein, 293 aa, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENSP ID: ENSP00000411607
MPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 85452 - protein, 393 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000445370
MPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 85453 - protein, 55 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000462381
MSKRPSYAPPPTPAPATQMPSTPGFVGYNPYSHLAYNNYRLGGNPGTNSRVTEIS

SEQ ID NO: 85454 - protein, 376 aa, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENSP ID: ENSP00000462475
MSKRPSYAPPPTPAPATASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 85455 - protein, 101 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000462857
MPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYM

SEQ ID NO: 85456 - protein, 288 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000463216
MQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEERE

SEQ ID NO: 85457 - protein, 129 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000463282
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNES

SEQ ID NO: 85458 - protein, 77 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000463405
MSKRPSYAPPPTPAPATQMPSTPGFVGYNPYSHLAYNNYRLGGNPGTNSRVTVGESTITASGKQLELTRNAFRIRSF

SEQ ID NO: 85459 - protein, 153 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000464061
MPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYM

SEQ ID NO: 85460 - protein, 52 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000464501
MSTNAQHTRVCGIQSIQSSRLQQLQAGREPGHQQPGHGILWYHDSKTPKATR

SEQ ID NO: 85461 - protein, 341 aa, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENSP ID: ENSP00000464511
MPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 85462 - protein, 177 aa, Homo sapiens
  Payload ID: 16975
  Gene Symbol: SMARCE1
  Gene Name: SWI/SNF related, matrix associated, actin dependent regulator of chromatin, subfamily e, member 1
  ENSP ID: ENSP00000466608
  MOD_RES (1)..(1): Any amino acid
XMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 85463 - protein, 1026 aa, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENSP ID: ENSP00000346217
MNLFNLDRFRFEKRNKIEEAPEATPQPSQPGPSSPISLSAEEENAEGEVSRANTPDSDITEKTEDSSVPETPDNERKASISYFKNQRGIQYIDLSSDSEDVVSPNCSNTVQEKTFNKDTVIIVSEPSEDEESQGLPTMARRNDDISELEDLSELEDLKDAKLQTLKELFPQRSDNDLLKLIESTSTMDGAIAAALLMFGDAGGGPRKRKLSSSSEPYEEDEFNDDQSIKKTRLDHGEESNESAESSSNWEKQESIVLKLQKEFPNFDKQELREVLKEHEWMYTEALESLKVFAEDQDMQYVSQSEVPNGKEVSSRSQNYPKNATKTKLKQKFSMKAQNGFNKKRKKNVFNPKRVVEDSEYDSGSDVGSSLDEDYSSGEEVMEDGYKGKILHFLQDASIGELTLIPQCSQKKAQKITELRPFNSWEALFTKMSKTNGLSEDLIWHCKTLIQERDVVIRLMNKCEDISNKLTKQVTMLTGNGGGWNIEQPSILNQSLSLKPYQKVGLNWLALVHKHGLNGILADEMGLGKTIQAIAFLAYLYQEGNNGPHLIVVPASTIDNWLREVNLWCPTLKVLCYYGSQEERKQIRFNIHSRYEDYNVIVTTYNCAISSSDDRSLFRRLKLNYAIFDEGHMLKNMGSIRYQHLMTINANNRLLLTGTPVQNNLLELMSLLNFVMPHMFSSSTSEIRRMFSSKTKSADEQSIYEKERIAHAKQIIKPFILRRVKEEVLKQLPPKKDRIELCAMSEKQEQLYLGLFNRLKKSINNLEKNTEMCNVMMQLRKMANHPLLHRQYYTAEKLKEMSQLMLKEPTHCEANPDLIFEDMEVMTDFELHVLCKQYRHINNFQLDMDLILDSGKFRVLGCILSELKQKGDRVVLFSQFTMMLDILEVLLKHHQHRYLRLDGKTQISERIHLIDEFNTDMDIFVFLLSTKAGGLGINLTSANVVILHDIDCNPYNDKQAEDRCHRVGQTKEVLVIKLISQGTIEESMLKINQQKLKLEQDMTTVDEGDEGSMPADIATLLKTSMGL

SEQ ID NO: 85464 - protein, 1028 aa, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENSP ID: ENSP00000351947
MNLFNLDRFRFEKRNKIEEAPEATPQPSQPGPSSPISLSAEEENAEGEVSRANTPDSDITEKTEDSSVPETPDNERKASISYFKNQRGIQYIDLSSDSEDVVSPNCSNTVQEKTFNKDTVIIVSEPSEDEESQGLPTMARRNDDISELEDLSELEDLKDAKLQTLKELFPQRSDNDLLKLIESTSTMDGAIAAALLMFGDAGGGPRKRKLSSSSEPYEEDEFNDDQSIKKTRLDHGEESNESAESSSNWEKQESIVLKLQKEFPNFDKQELREVLKEHEWMYTEALESLKVFAEDQDMQYVSQSEVPNGKEVSSRSQNYPKNATKTKLKQKFSMKAQNGFNKKRKKNVFNPKRVVEDSEYDSGSDVGSSLDEDYSSGEEVMEDGYKGKILHFLQDASIGELTLIPQCSQKKAQKITELRPFNSWEALFTKMSKTNGLSEDLIWHCKTLIQERDVVIRLMNKCEDISNKLTKQVTMLTGNGGGWNIEQPSILNQSLSLKPYQKVGLNWLALVHKHGLNGILADEMGLGKTIQAIAFLAYLYQEGNNGPHLIVVPASTIDNWLREVNLWCPTLKVLCYYGSQEERKQIRFNIHSRYEDYNVIVTTYNCAISSSDDRSLFRRLKLNYAIFDEGHMLKNMGSIRYQHLMTINANNRLLLTGTPVQNNLLELMSLLNFVMPHMFSSSTSEIRRMFSSKTKSADEQSIYEKERIAHAKQIIKPFILRRVKEEVLKQLPPKKDRIELCAMSEKQEQLYLGLFNRLKKSINNLVTEKNTEMCNVMMQLRKMANHPLLHRQYYTAEKLKEMSQLMLKEPTHCEANPDLIFEDMEVMTDFELHVLCKQYRHINNFQLDMDLILDSGKFRVLGCILSELKQKGDRVVLFSQFTMMLDILEVLLKHHQHRYLRLDGKTQISERIHLIDEFNTDMDIFVFLLSTKAGGLGINLTSANVVILHDIDCNPYNDKQAEDRCHRVGQTKEVLVIKLISQGTIEESMLKINQQKLKLEQDMTTVDEGDEGSMPADIATLLKTSMGL

SEQ ID NO: 85465 - protein, 70 aa, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  ENSP ID: ENSP00000378413
MNLFNLDRFRFEKRNKIEEAPEATPQPSQPGPSSPISLSAEEENAEGEVSRANTPDSDITEKTVSLEGLK

SEQ ID NO: 85466 - protein, 1028 aa, Homo sapiens; identical to SEQ ID NO: 85464
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENSP ID: ENSP00000415576

SEQ ID NO: 85467 - protein, 596 aa, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENSP ID: ENSP00000423286
MSKTNGLSEDLIWHCKTLIQERDVVIRLMNKCEDISNKLTKQVTMLTGNGGGWNIEQPSILNQSLSLKPYQKVGLNWLALVHKHGLNGILADEMGLGKTIQAIAFLAYLYQEGNNGPHLIVVPASTIDNWLREVNLWCPTLKVLCYYGSQEERKQIRFNIHSRYEDYNVIVTTYNCAISSSDDRSLFRRLKLNYAIFDEGHMLKNMGSIRYQHLMTINANNRLLLTGTPVQNNLLELMSLLNFVMPHMFSSSTSEIRRMFSSKTKSADEQSIYEKERIAHAKQIIKPFILRRVKEEVLKQLPPKKDRIELCAMSEKQEQLYLGLFNRLKKSINNLEKNTEMCNVMMQLRKMANHPLLHRQYYTAEKLKEMSQLMLKEPTHCEANPDLIFEDMEVMTDFELHVLCKQYRHINNFQLDMDLILDSGKFRVLGCILSELKQKGDRVVLFSQFTMMLDILEVLLKHHQHRYLRLDGKTQISERIHLIDEFNTDMDIFVFLLSTKAGGLGINLTSANVVILHDIDCNPYNDKQAEDRCHRVGQTKEVLVIKLISQGTIEESMLKINQQKLKLEQDMTTVDEGDEGSMPADIATLLKTSMGL

SEQ ID NO: 85468 - protein, 244 aa, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  ENSP ID: ENSP00000424624
MNLFNLDRFRFEKRNKIEEAPEATPQPSQPGPSSPISLSAEEENAEGEVSRANTPDSDITEKTEDSSVPETPDNERKASISYFKNQRGIQYIDLSSDSEDVVSPNCSNTVQEKTFNKDTVIIVSEPSEDEESQGLPTMARRNDDISELEDLSELEDLKDAKLQTLKELFPQRSDNDLLKLIESTSTMDGAIAAALLMFGDAGGGPRKRKLSSSSEPYEEDEFNDDQSIKKTRLDHCAWAVKVAV

SEQ ID NO: 85469 - protein, 235 aa, Homo sapiens
  Payload ID: 16977
  Gene Symbol: SWI5
  Gene Name: SWI5 homologous recombination repair protein
  Uniprot ID: Q1ZZU3
  ENSP ID: ENSP00000316609
MQRRGQRDLWRHNKSCARNRCPRPPRERGGAGFPWVRAQLSVRQFTLRVRVPGPVHLRGRSPTPALDPLAPLNPLIRGPRTPGLRRWIQSLALLLPNCSSSRIPTVPRPHSGLWVQSDFPLGFLSRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 85470 - protein, 145 aa, Homo sapiens
  Payload ID: 16977
  Gene Symbol: SWI5
  Gene Name: SWI5 homologous recombination repair protein
  ENSP ID: ENSP00000361989
  MOD_RES (1)..(1): Any amino acid
XSLETRDQRTPGGPVWGGRRTEPRLTRSCRGAFRSPFLPATFEKTLYCPHVERPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 85471 - protein, 130 aa, Homo sapiens
  Payload ID: 16977
  Gene Symbol: SWI5
  Gene Name: SWI5 homologous recombination repair protein
  ENSP ID: ENSP00000411469
LDPLAPLNPLIRGPRTPGLRRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 85472 - protein, 139 aa, Homo sapiens
  Payload ID: 16977
  Gene Symbol: SWI5
  Gene Name: SWI5 homologous recombination repair protein
  ENSP ID: ENSP00000419719
MGEGTAGPGPRSLETRDQRTPGGPVWGGRRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 85473 - protein, 170 aa, Homo sapiens
  Payload ID: 16977
  Gene Symbol: SWI5
  Gene Name: SWI5 homologous recombination repair protein
  ENSP ID: ENSP00000476650
LDPLAPLNPLIRGPRTPGLRRWIQSLALLLPNCSSSRIPTVPRPHSGLWVQSDFPLGFLSRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 85474 - protein, 151 aa, Homo sapiens
  Payload ID: 16977
  Gene Symbol: SWI5
  Gene Name: SWI5 homologous recombination repair protein
  ENSP ID: ENSP00000477295
LDPLAPLNPLIRGPRTPGLRRWIQSLALLLPNCSSSRIPTVPRPHSGLWVQSDFPLGFLSRTEPRLTRSCRGAFRSPRPLPKSGQADGTSEESLHLDIQKLKEKRDMLDKEISQFVSEGYSVDELEDHITQLHEYNDIKDVGQMLMGKLGE

SEQ ID NO: 85475 - protein, 245 aa, Homo sapiens
  Payload ID: 16978
  Gene Symbol: SFR1
  Gene Name: SWI5-dependent homologous recombination repair protein 1
  Uniprot ID: Q86XK3
  ENSP ID: ENSP00000358742
MAEGEKNQDFTFKMESPSDSAVVLPSTPQASANPSSPYTNSSRKQPMSATLRERLRKTRFSFNSSYNVVKRLKVESEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 85476 - protein, 232 aa, Homo sapiens
  Payload ID: 16978
  Gene Symbol: SFR1
  Gene Name: SWI5-dependent homologous recombination repair protein 1
  Uniprot ID: Q86XK3
  ENSP ID: ENSP00000358744
MESPSDSAVVLPSTPQASANPSSPYTNSSRKQPMSATLRERLRKTRFSFNSSYNVVKRLKVESEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 85477 - protein, 229 aa, Homo sapiens
  Payload ID: 16979
  Gene Symbol: SWSAP1
  Gene Name: SWIM-type zinc finger 7 associated protein 1
  Uniprot ID: Q6NVH7
  ENSP ID: ENSP00000310008
MPAAGPPLLLLGTPGSGKTALLFAAALEAAGEGQGPVLFLTRRPLQSMPRGTGTTLDPMRLQKIRFQYPPSTRELFRLLCSAHEAPGPAPSLLLLDGLEEYLAEDPEPQEAAYLIALLLDTAAHFSHRLGPGRDCGLMVALQTQEEAGSGDVLHLALLQRYFPAQCWLQPDAPGPGEHGLRACLEPGGLGPRTEWWVTFRSDGEMMIAPWPTQAGDPSSGKGSSSGGQP

SEQ ID NO: 85478 - protein, 900 aa, Homo sapiens
  Payload ID: 16980
  Gene Symbol: SWT1
  Gene Name: SWT1 RNA endoribonuclease homolog
  Uniprot ID: Q5T5J6
  ENSP ID: ENSP00000356470
MSSKESCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASDVKPKAEGQASENKWSHLLVQREKMKELKKGRNSKFRDNSEKCVLEKWKRNQFSQDYNSNKIIKEPLGSRRQKISFKIPIKSRDTLQKLVEENVFNIDSNNSKTKQEEREYLESSQVSLNVTRQKTEHLLSDFTYKRTVHEWKRKHHYDHQESNDSHSRENLTQSFEAPCCSVSSESIQDADQEMQIVEELHAARVGKSVDLPGELMSMEIDLEDDVHSSSANNTSDRKLLIVIDTNILMNHLKFVRILKTTEVPGFDKLVLIIPWVVMQELDRMKEGKLLKRAQHKAIPAVHFINDSLKNQDRKLWGQSIQLASQKHYGLSDENNDDRVLKCCLQHQELFPCSFVILCTDDRNLRNKGLISGVKSLSKEELSAELLHLSLNTDVCHQPCIPKQQLKAETTPLKESYKEESTNSGLSILLESIVSDLEKSLGTGLSSILETEMKIAFGNLWMEILYLKPPWTLLHLLQCFKKHWLAVFGLVMEKNLLLTIESLYKNLRKANKAVDFTTVKFLLQDSRSLLHAFSTRSNYDGILPQTFAQVNNLLQTFAEVKTKLKPNSSENTVTKKQEGTSLKNSHNQEITVFSSSHLPQPSRHQEIWSILESVWITIYQNSTDVFQRLGSNSALTTSNIASFEEAFICLQKLMAAVRDILEGIQRILAPNSNYQDVETLYNFLIKYEVNKNVKFTAQEIYDCVSQTEYREKLTIGCRQLVEMEYTMQQCNASVYMEAKNRGWCEDMLNYRI

SEQ ID NO: 85479 - protein, 900 aa, Homo sapiens; identical to SEQ ID NO: 85478
  Payload ID: 16980
  Gene Symbol: SWT1
  Gene Name: SWT1 RNA endoribonuclease homolog
  Uniprot ID: Q5T5J6
  ENSP ID: ENSP00000356471

SEQ ID NO: 85480 - protein, 159 aa, Homo sapiens
  Payload ID: 16980
  Gene Symbol: SWT1
  Gene Name: SWT1 RNA endoribonuclease homolog
  ENSP ID: ENSP00000401413
MSSKESCGKKETSQRKDTTTSSPNFGEKDKKERKTPASSTSSSSIRSVSSEKRKLKSDHTDVLYYNIKRRQGLKRLSVEIDTLRRRPKIGSSSQRPIKLKEASYSNDNQIILQSPSSNGTKKDIHKCVDFKPKDIKLTNAGSKLDHGIKSLSSPKIASD

SEQ ID NO: 85481 - protein, 243 aa, Homo sapiens
  Payload ID: 16981
  Gene Symbol: SYF2
  Gene Name: SYF2 pre-mRNA-splicing factor
  Uniprot ID: O95926
  ENSP ID: ENSP00000236273
MAAIAASEVLVDSAEEGSLAAAAELAAQKREQRLRKFRELHLMRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 85482 - protein, 201 aa, Homo sapiens
  Payload ID: 16981
  Gene Symbol: SYF2
  Gene Name: SYF2 pre-mRNA-splicing factor
  Uniprot ID: O95926
  ENSP ID: ENSP00000346330
MAAIAASEVLVDSAEEGSLAAAAELAAQKREQRLRKFRELHLMRECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 85483 - protein, 1274 aa, Homo sapiens
  Payload ID: 16982
  Gene Symbol: SYMPK
  Gene Name: symplekin
  Uniprot ID: Q92797
  ENSP ID: ENSP00000245934
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 85484 - protein, 142 aa, Homo sapiens
  Payload ID: 16982
  Gene Symbol: SYMPK
  Gene Name: symplekin
  ENSP ID: ENSP00000469296
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQ

SEQ ID NO: 85485 - protein, 95 aa, Homo sapiens
  Payload ID: 16982
  Gene Symbol: SYMPK
  Gene Name: symplekin
  ENSP ID: ENSP00000470957
  MOD_RES (1)..(1): Any amino acid
XPRLGGFVMNILSRLIMKQVWKYPKVWEGFIKCCQRTKPQSFQVILQLPPQQLGAVFDKCPELREPLLAHVRSFTPHQSCPQRPLPALHPASSHP

SEQ ID NO: 85486 - protein, 50 aa, Homo sapiens
  Payload ID: 16982
  Gene Symbol: SYMPK
  Gene Name: symplekin
  ENSP ID: ENSP00000470977
MASGSGDSVTRRSVASQFFTQEEGPGIDGMTTSERVVDLLNQAALITNDS

SEQ ID NO: 85487 - protein, 137 aa, Homo sapiens
  Payload ID: 16982
  Gene Symbol: SYMPK
  Gene Name: symplekin
  ENSP ID: ENSP00000471694
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLY

SEQ ID NO: 85488 - protein, 115 aa, Homo sapiens
  Payload ID: 16982
  Gene Symbol: SYMPK
  Gene Name: symplekin
  ENSP ID: ENSP00000471770
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLN

SEQ ID NO: 85489 - protein, 673 aa, Homo sapiens
  Payload ID: 16982
  Gene Symbol: SYMPK
  Gene Name: symplekin
  ENSP ID: ENSP00000473136
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGSSPRLCWRRHSSQRVPWRWSASTARMRVAPIWACPHFET

SEQ ID NO: 85490 - protein, 1058 aa, Homo sapiens
  Payload ID: 16982
  Gene Symbol: SYMPK
  Gene Name: symplekin
  ENSP ID: ENSP00000478599
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKGEALPPHSSGLAPATPGQDLSHPHAPTGICQVKDCHSQPHLRALESHLPPSLLFLPPLPSLPPSLLLPSSQVLPFTTHLFLPLMYLLCPGTEWA

SEQ ID NO: 85491 - protein, 1058 aa, Homo sapiens; identical to SEQ ID NO: 85490
  Payload ID: 16982
  Gene Symbol: SYMPK
  Gene Name: symplekin
  ENSP ID: ENSP00000479480

SEQ ID NO: 85492 - protein, 352 aa, Homo sapiens
  Payload ID: 16983
  Gene Symbol: SYAP1
  Gene Name: synapse associated protein 1
  Uniprot ID: Q96A49
  ENSP ID: ENSP00000369500
MFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 85493 - protein, 735 aa, Homo sapiens
  Payload ID: 16984
  Gene Symbol: SYDE1
  Gene Name: synapse defective 1, Rho GTPase, homolog 1 (C. elegans)
  Uniprot ID: Q6ZW31
  ENSP ID: ENSP00000341489
MAEPLLRKTFSRLRGREKLPRKKSDAKERGHPAQRPEPSPPEPEPQAPEGSQAGAEGPSSPEASRSPARGAYLQSLEPSSRRWVLGGAKPAEDTSLGPGVPGTGEPAGEIWYNPIPEEDPRPPAPEPPGPQPGSAESEGLAPQGAAPASPPTKASRTKSPGPARRLSIKMKKLPELRRRLSLRGPRAGRERERAAPAGSVISRYHLDSSVGGPGPAAGPGGTRSPRAGYLSDGDSPERPAGPPSPTSFRPYEVGPAARAPPAALWGRLSLHLYGLGGLRPAPGATPRDLCCLLQVDGEARARTGPLRGGPDFLRLDHTFHLELEAARLLRALVLAWDPGVRRHRPCAQGTVLLPTVFRGCQAQQLAVRLEPQGLLYAKLTLSEQQEAPATAEPRVFGLPLPLLVERERPPGQVPLIIQKCVGQIERRGLRVVGLYRLCGSAAVKKELRDAFERDSAAVCLSEDLYPDINVITGILKDYLRELPTPLITQPLYKVVLEAMARDPPNRVPPTTEGTRGLLSCLPDVERATLTLLLDHLRLVSSFHAYNRMTPQNLAVCFGPVLLPARQAPTRPRARSSGPGLASAVDFKHHIEVLHYLLQSWPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCL

SEQ ID NO: 85494 - protein, 392 aa, Homo sapiens
  Payload ID: 16984
  Gene Symbol: SYDE1
  Gene Name: synapse defective 1, Rho GTPase, homolog 1 (C. elegans)
  ENSP ID: ENSP00000469489
MKLQSTPGSGPLVSSGCQAQQLAVRLEPQGLLYAKLTLSEQQEAPATAEPRVFGLPLPLLVERERPPGQVPLIIQKCVGQIERRGLRVVGLYRLCGSAAVKKELRDAFERDSAAVCLSEDLYPDINVITGILKDYLRELPTPLITQPLYKVVLEAMARDPPNRVPPTTEGTRGLLSCLPDVERATLTLLLDHLRLVSSFHAYNRMTPQNLAVCFGPVLLPARQAPTRPRARSSGPGLASAVDFKHHIEVLHYLLQSWPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCL

SEQ ID NO: 85495 - protein, 668 aa, Homo sapiens
  Payload ID: 16984
  Gene Symbol: SYDE1
  Gene Name: synapse defective 1, Rho GTPase, homolog 1 (C. elegans)
  Uniprot ID: Q6ZW31
  ENSP ID: ENSP00000470733
MAEPLLRKTFSRLRGREKLPRKKSDAKERGPGVPGTGEPAGEIWYNPIPEEDPRPPAPEPPGPQPGSAESEGLAPQGAAPASPPTKASRTKSPGPARRLSIKMKKLPELRRRLSLRGPRAGRERERAAPAGSVISRYHLDSSVGGPGPAAGPGGTRSPRAGYLSDGDSPERPAGPPSPTSFRPYEVGPAARAPPAALWGRLSLHLYGLGGLRPAPGATPRDLCCLLQVDGEARARTGPLRGGPDFLRLDHTFHLELEAARLLRALVLAWDPGVRRHRPCAQGTVLLPTVFRGCQAQQLAVRLEPQGLLYAKLTLSEQQEAPATAEPRVFGLPLPLLVERERPPGQVPLIIQKCVGQIERRGLRVVGLYRLCGSAAVKKELRDAFERDSAAVCLSEDLYPDINVITGILKDYLRELPTPLITQPLYKVVLEAMARDPPNRVPPTTEGTRGLLSCLPDVERATLTLLLDHLRLVSSFHAYNRMTPQNLAVCFGPVLLPARQAPTRPRARSSGPGLASAVDFKHHIEVLHYLLQSWPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCL

SEQ ID NO: 85496 - protein, 190 aa, Homo sapiens
  Payload ID: 16984
  Gene Symbol: SYDE1
  Gene Name: synapse defective 1, Rho GTPase, homolog 1 (C. elegans)
  ENSP ID: ENSP00000471553
  MOD_RES (1)..(1): Any amino acid
XTLSEQQEAPATAEPRVFGLPLPLLVERERPPGQVPLIIQKCVGQIERRGLRVVGLYRLCGSAAVKKELRDAFERDSAAVCLSEDLYPDINVITGHADASPGPPAPRLLLPCLQPHDPTELGRVLRACAAAGTPGAHKASCPQLRPRPCQCSGLQAPHRGAALPAAVLARSPPAPTISRCRALLATQTTA

SEQ ID NO: 85497 - protein, 170 aa, Homo sapiens
  Payload ID: 16984
  Gene Symbol: SYDE1
  Gene Name: synapse defective 1, Rho GTPase, homolog 1 (C. elegans)
  ENSP ID: ENSP00000473151
MAEPLLRKTFSRLRGREKLPRKKSDAKERGHPAQRPEPSPPEPEPQAPEGSQAGAEGPSSPEASRSPARGAYLQSLEPSSRRWVLGGAKPAEDTSLGPGVPGTGEPAGEIWYNPIPEEDPRPPAPEPPGPQPGSAESEGLAPQGKNKLPIPFPKVSTSSTSLPFRVAPAS

SEQ ID NO: 85498 - protein, 1194 aa, Homo sapiens
  Payload ID: 16985
  Gene Symbol: SYDE2
  Gene Name: synapse defective 1, Rho GTPase, homolog 2 (C. elegans)
  Uniprot ID: Q5VT97
  ENSP ID: ENSP00000340594
MHDLPPDSGARRGGRGLADHSFPAGARAPGQPPSRGAAYRRACPRDGERGGGGRPRQQVSPPRSPQREPRGGQLRTPRMRPSCSRSLESLRVGAKPPPFQRWPSDSWIRCGAHRDWDEPPPRGGRMDGWSGDRARAAAPTGLQPPGCKDHGCSSGSPFRDPAGSSVIRSGKGDRQEGPSFLRPPAVTVKKLQKWMYKGRLLSLGMKGRARGTAPKVTGTQAASPNVGALKVRENRVLSVPPDQRITLTDLFENAYGSSMKGRELEELKDNIEFRGHKPLNSITVSKKRNWLYQSTLRPLNLEEENKKCQDRSHLSISPVSLPKHQLSQSFLKSSKEYCTYVVCNATNSSLSKNCALDFNEENDADDEGEIWYNPIPEDDDLGISSALSFGEADSAVLKLPAVNLSMLSGSDLMKAERHTEDSLCSSEHAGDIQTTRSNGMNPIHPAHSTEFVQQYKQKLGHKTQEGIMVEDSPMLKSPFAGSGILAATNSTELGIMEPSSPNPSPVKKGSSINWSLPDKIKSPRTVRKLSMKMKKLPEFSRKLSVKGTLNYINSPDNTPSLSKYNCREVHHTDILPSGNTTTAAKRNVISRYHLDTSVSSQQSYQKKNSMSSKYSCKGGYLSDGDSPELTTKASKHGSENKFGKGKEIISNSCSKNEIDIDAFRHYSFSDQPKCSQYISGLMSVHFYGAEDLKPPRIDSKDVFCAIQVDSVNKARTALLTCRTTFLDMDHTFNIEIENAQHLKLVVFSWEPTPRKNRVCCHGTVVLPTLFRVTKTHQLAVKLEPRGLIYVKVTLMEQWENSLHGLDINQEPIIFGVDIQKVVEKENIGLMVPLLIQKCIMEIEKRGCQVVGLYRLCGSAAVKKELREAFERDSKAVGLCENQYPDINVITGVLKDYLRELPSPLITKQLYEAVLDAMAKSPLKMSSNGCENDPGDSKYTVDLLDCLPEIEKATLKMLLDHLKLVASYHEVNKMTCQNLAVCFGPVLLSQRQEPSTHNNRVFTDSEELASALDFKKHIEVLHYLLQLWPVQRLTVKKSTDNLFPEQKSSLNYLRQKKERPHMLNLSGTDSSGVLRPRQNRLDSPLSNRYAGDWSSCGENYFLNTKENLNDVDYDDVPSEDRKIGENYSKMDGPEVMIEQPIPMSKECTFQTYLTMQTVESTVDRKNNLKDLQESIDTLIGNLERELNKNKLNMSF

SEQ ID NO: 85499 - protein, 258 aa, Homo sapiens
  Payload ID: 16986
  Gene Symbol: SYNDIG1
  Gene Name: synapse differentiation inducing 1
  Uniprot ID: Q9H7V2
  ENSP ID: ENSP00000366058
MDGIIEQKSMLVHSKISDAGKRNGLINTRNLMAESRDGLVSVYPAPQYQSHRVGASTVPASLDSSRSEPMQQLLDPNTLQQSVESRYRPNIILYSEGVLRSWGDGVAADCCETTFIEDRSPTKDSLEYPDGKFIDLSADDIKIHTLSYDVEEEEEFQELESDYSSDTESEDNFLMMPPRDHLGLSVFSMLCCFWPLGIAAFYLSHETNKAVAKGDLHQASTSSRRALFLAVLSITIGTGVYVGVAVALIAYLSKNNHL

SEQ ID NO: 85500 - protein, 238 aa, Homo sapiens
  Payload ID: 16987
  Gene Symbol: SYNDIG1L
  Gene Name: synapse differentiation inducing 1-like
  Uniprot ID: A6NDD5
  ENSP ID: ENSP00000331474
MESLSELQNPLLPRSPAHLHGPYPYPETPPSWSCQEKLYSYLLGGAGPAGAHQLLDPGSLQLAVEAWYRPSCLLGRDKVKEPRAGSCETSFTEDREPQEGPPEQPTGPGQAAENVTIQTVSYGVQEELRDQEDDQEEEESDATSTESESEDNFLTLPPRDHLGLTLFSMLCCFWPLGIAAFYFSQGTSKAISKGDFRLASTTSRRALFLATLAIAVGAGLYVAVVVALAAYMSQNGHG

SEQ ID NO: 85501 - protein, 238 aa, Homo sapiens; identical to SEQ ID NO: 85500
  Payload ID: 16987
  Gene Symbol: SYNDIG1L
  Gene Name: synapse differentiation inducing 1-like
  Uniprot ID: A6NDD5
  ENSP ID: ENSP00000450439

SEQ ID NO: 85502 - protein, 80 aa, Homo sapiens
  Payload ID: 16987
  Gene Symbol: SYNDIG1L
  Gene Name: synapse differentiation inducing 1-like
  ENSP ID: ENSP00000451519
MESLSELQNPLLPRSPAHLHGPYPYPETPPSWSCQEKLYSYLLGGAGPAGAHQLLDPGSLQLAVEAWYRPSCLLGRDKVK

SEQ ID NO: 85503 - protein, 705 aa, Homo sapiens
  Payload ID: 16988
  Gene Symbol: SYN1
  Gene Name: synapsin I
  Uniprot ID: P17600
  ENSP ID: ENSP00000295987
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLNKSQSLTNAFNLPEPAPPRPSLSQDEVKAETIRSLRKSFASLFSD

SEQ ID NO: 85504 - protein, 669 aa, Homo sapiens
  Payload ID: 16988
  Gene Symbol: SYN1
  Gene Name: synapsin I
  Uniprot ID: P17600
  ENSP ID: ENSP00000343206
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLKASPAQAQP

SEQ ID NO: 85505 - protein, 221 aa, Homo sapiens
  Payload ID: 16989
  Gene Symbol: SYN2
  Gene Name: synapsin II
  ENSP ID: ENSP00000480038
  MOD_RES (1)..(1): Any amino acid
XLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGCLQYILDCNGIAVGPKQVQAS

SEQ ID NO: 85506 - protein, 582 aa, Homo sapiens
  Payload ID: 16989
  Gene Symbol: SYN2
  Gene Name: synapsin II
  ENSP ID: ENSP00000480050
MMNFLRRRLSDSSFIANLPNGYMTDLQRPEPQQPPPPPPPGPGAASASAAPPTASPGPERRPPPASAPAPQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGGPGQPQGMQPPGKVLPPRRLPPGPSLPPSSSSSSSSSSSAPQRPGGPTTHGDAPSSSSSLAEAQPPLAAPPQKPQPHPQLNKSQSLTNAFSFSESSFFRSSANEDEAKAETIRSLRKSFASLFSD

SEQ ID NO: 85507 - protein, 478 aa, Homo sapiens
  Payload ID: 16989
  Gene Symbol: SYN2
  Gene Name: synapsin II
  ENSP ID: ENSP00000484916
MMNFLRRRLSDSSFIANLPNGYMTDLQRPEPQQPPPPPPPGPGAASASAAPPTASPGPERRPPPASAPAPQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGCLQYILDCNGIAVGPKQVQAS

SEQ ID NO: 85508 - protein, 323 aa, Homo sapiens [sequence omitted]

SEQ ID NO: 85509 - protein, 580 aa, Homo sapiens
  Payload ID: 16990
  Gene Symbol: SYN3
  Gene Name: synapsin III
  Uniprot ID: O14994
  ENSP ID: ENSP00000351614
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQAEFSELNLAAYVTGGCMVDMQVVRNGTKVVSRSFKPDFILVRQHAYSMALGEDYRSLVIGLQYGGLPAVNSLYSVYNFCSKPWVFSQLIKIFHSLGPEKFPLVEQTFFPNHKPMVTAPHFPVVVKLGHAHAGMGKIKVENQLDFQDITSVVAMAKTYATTEAFIDSKYDIRIQKIGSNYKAYMRTSISGNWKANTGSAMLEQVAMTERYRLWVDSCSEMFGGLDICAVKAVHSKDGRDYIIEVMDSSMPLIGEHVEEDRQLMADLVVSKMSQLPMPGGTAPSPLRPWAPQIKSAKSPGQAQLGPQLGQPQPRPPPQGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 85510 - protein, 113 aa, Homo sapiens
  Payload ID: 16990
  Gene Symbol: SYN3
  Gene Name: synapsin III
  ENSP ID: ENSP00000388582
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKV

SEQ ID NO: 85511 - protein, 123 aa, Homo sapiens
  Payload ID: 16990
  Gene Symbol: SYN3
  Gene Name: synapsin III
  ENSP ID: ENSP00000395794
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQ

SEQ ID NO: 85512 - protein, 187 aa, Homo sapiens [sequence omitted]

SEQ ID NO: 85513 - protein, 1284 aa, Homo sapiens
  Payload ID: 16991
  Gene Symbol: SYNGAP1
  Gene Name: synaptic Ras GTPase activating protein 1
  ENSP ID: ENSP00000293748
MSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQLLIR

SEQ ID NO: 85514 - protein, 487 aa, Homo sapiens
  Payload ID: 16991
  Gene Symbol: SYNGAP1
  Gene Name: synaptic Ras GTPase activating protein 1
  ENSP ID: ENSP00000348072
EDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPST

SEQ ID NO: 85515 - protein, 1299 aa, Homo sapiens
  Payload ID: 16991
  Gene Symbol: SYNGAP1
  Gene Name: synaptic Ras GTPase activating protein 1
  Uniprot ID: Q96PV0
  ENSP ID: ENSP00000378509
MSRSRASIHRGSIPAMSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQLLIR

SEQ ID NO: 85516 - protein, 1285 aa, Homo sapiens
  Payload ID: 16991
  Gene Symbol: SYNGAP1
  Gene Name: synaptic Ras GTPase activating protein 1
  Uniprot ID: Q96PV0
  ENSP ID: ENSP00000403636
MSRSRASIHRGSIPAMSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGSPSLQADAGGGGAAPGPPRHG

SEQ ID NO: 85517 - protein, 1284 aa, Homo sapiens
  Payload ID: 16991
  Gene Symbol: SYNGAP1
  Gene Name: synaptic Ras GTPase activating protein 1
  Uniprot ID: Q96PV0
  ENSP ID: ENSP00000407995
MGLRPPTPSPSGGSCSGSLPPPSRCQPLRRRCSSCCFPGEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQERQLPPLGPTNPRVTLAPPWNGLAPPAPPPPPRLQITENGEFRNTADH

SEQ ID NO: 85518 - protein, 1284 aa, Homo sapiens; identical to SEQ ID NO: 85517
  Payload ID: 16991
  Gene Symbol: SYNGAP1
  Gene Name: synaptic Ras GTPase activating protein 1
  Uniprot ID: Q96PV0
  ENSP ID: ENSP00000412475

SEQ ID NO: 85519 - protein, 1343 aa, Homo sapiens [sequence omitted]

SEQ ID NO: 85520 - protein, 1306 aa, Homo sapiens
  Payload ID: 16991
  Gene Symbol: SYNGAP1
  Gene Name: synaptic Ras GTPase activating protein 1
  ENSP ID: ENSP00000416519
MSRSRASIHRGSIPAMSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDREYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQERQLPPLGPTNPRVTLAPPWNGLAPPA

SEQ ID NO: 85521 - protein, 1299 aa, Homo sapiens; identical to SEQ ID NO: 85515
  Payload ID: 16991
  Gene Symbol: SYNGAP1
  Gene Name: synaptic Ras GTPase activating protein 1
  Uniprot ID: Q96PV0
  ENSP ID: ENSP00000486431

SEQ ID NO: 85522 - protein, 1343 aa, Homo sapiens [sequence omitted]

SEQ ID NO: 85523 - protein, 682 aa, Homo sapiens
  Payload ID: 16992
  Gene Symbol: SV2A
  Gene Name: synaptic vesicle glycoprotein 2A
  Uniprot ID: Q7L0J3
  ENSP ID: ENSP00000358141
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKR

SEQ ID NO: 85524 - protein, 742 aa, Homo sapiens
  Payload ID: 16992
  Gene Symbol: SV2A
  Gene Name: synaptic vesicle glycoprotein 2A
  Uniprot ID: Q7L0J3
  ENSP ID: ENSP00000358142
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 85525 - protein, 683 aa, Homo sapiens
  Payload ID: 16993
  Gene Symbol: SV2B
  Gene Name: synaptic vesicle glycoprotein 2B
  Uniprot ID: Q7L1I2
  ENSP ID: ENSP00000332818
MDDYKYQDNYGGYAPSDGYYRGNESNPEEDAQSDVTEGHDEEDEIYEGEYQGIPHPDDVKAKQAKMAPSRMDSLRGQTDLMAERLEDEEQLAHQYETIMDECGHGRFQWILFFVLGLALMADGVEVFVVSFALPSAEKDMCLSSSKKGMLGMIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 85526 - protein, 683 aa, Homo sapiens; identical to SEQ ID NO: 85525
  Payload ID: 16993
  Gene Symbol: SV2B
  Gene Name: synaptic vesicle glycoprotein 2B
  Uniprot ID: Q7L1I2
  ENSP ID: ENSP00000377779

SEQ ID NO: 85527 - protein, 532 aa, Homo sapiens
  Payload ID: 16993
  Gene Symbol: SV2B
  Gene Name: synaptic vesicle glycoprotein 2B
  Uniprot ID: Q7L1I2
  ENSP ID: ENSP00000443243
MIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 85528 - protein, 683 aa, Homo sapiens; identical to SEQ ID NO: 85525
  Payload ID: 16993
  Gene Symbol: SV2B
  Gene Name: synaptic vesicle glycoprotein 2B
  Uniprot ID: Q7L1I2
  ENSP ID: ENSP00000450992

SEQ ID NO: 85529 - protein, 676 aa, Homo sapiens
  Payload ID: 16994
  Gene Symbol: SV2C
  Gene Name: synaptic vesicle glycoprotein 2C
  ENSP ID: ENSP00000316983
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGSIVYLGMMVGAFFWGGLADKVGRKQSLLICMSVNGFFAFLSSFVQGYGFFLFCRLLSGFGIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFTINFTMENQIHTGMEYDNGRFIGVKFKSVTFKDSVFKSCTFEDVTSVNTYFKNCTFIDTVFDNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRRRVLPCCPG

SEQ ID NO: 85530 - protein, 727 aa, Homo sapiens
  Payload ID: 16994
  Gene Symbol: SV2C
  Gene Name: synaptic vesicle glycoprotein 2C
  Uniprot ID: Q496J9
  ENSP ID: ENSP00000423541
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGSIVYLGMMVGAFFWGGLADKVGRKQSLLICMSVNGFFAFLSSFVQGYGFFLFCRLLSGFGIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFTINFTMENQIHTGMEYDNGRFIGVKFKSVTFKDSVFKSCTFEDVTSVNTYFKNCTFIDTVFDNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRATGFGFLNALCKAAAVLGNLIFGSLVSITKSIPILLASTVLVCGGLVGLCLPDTRTQVLM

SEQ ID NO: 85531 - protein, 118 aa, Homo sapiens
  Payload ID: 16995
  Gene Symbol: SYNGR1
  Gene Name: synaptogyrin 1
  ENSP ID: ENSP00000216155
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAWEMHS

SEQ ID NO: 85532 - protein, 191 aa, Homo sapiens
  Payload ID: 16995
  Gene Symbol: SYNGR1
  Gene Name: synaptogyrin 1
  Uniprot ID: O43759
  ENSP ID: ENSP00000318845
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWSLTAALAVRRFKDLSFQEEYSTLFPASAQP

SEQ ID NO: 85533 - protein, 233 aa, Homo sapiens
  Payload ID: 16995
  Gene Symbol: SYNGR1
  Gene Name: synaptogyrin 1
  Uniprot ID: O43759
  ENSP ID: ENSP00000332287
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWAGQAVLAFQRYQIGADSALFSQDYMDPSQDSSMPYAPYVEPTGPDPAGMGGTYQQPANTFDTEPQGYQSQGY

SEQ ID NO: 85534 - protein, 192 aa, Homo sapiens
  Payload ID: 16995
  Gene Symbol: SYNGR1
  Gene Name: synaptogyrin 1
  Uniprot ID: O43759
  ENSP ID: ENSP00000370946
MLTLEFGILEFDPSWIGSWTQRSWVSWRSRPGCELFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWSLTAALAVRRFKDLSFQEEYSTLFPASAQP

SEQ ID NO: 85535 - protein, 169 aa, Homo sapiens
  Payload ID: 16995
  Gene Symbol: SYNGR1
  Gene Name: synaptogyrin 1
  ENSP ID: ENSP00000385447
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWRSGATSPP

SEQ ID NO: 85536 - protein, 144 aa, Homo sapiens
  Payload ID: 16995
  Gene Symbol: SYNGR1
  Gene Name: synaptogyrin 1
  ENSP ID: ENSP00000412442
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSGEPHPAGTPCTESTEGCPGHRRRLPPFFPCFR

SEQ ID NO: 85537 - protein, 224 aa, Homo sapiens
  Payload ID: 16996
  Gene Symbol: SYNGR2
  Gene Name: synaptogyrin 2
  Uniprot ID: O43760
  ENSP ID: ENSP00000225777
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 85538 - protein, 168 aa, Homo sapiens
  Payload ID: 16996
  Gene Symbol: SYNGR2
  Gene Name: synaptogyrin 2
  ENSP ID: ENSP00000465005
MYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 85539 - protein, 224 aa, Homo sapiens; identical to SEQ ID NO: 85537
  Payload ID: 16996
  Gene Symbol: SYNGR2
  Gene Name: synaptogyrin 2
  Uniprot ID: O43760
  ENSP ID: ENSP00000465678

SEQ ID NO: 85540 - protein, 65 aa, Homo sapiens
  Payload ID: 16996
  Gene Symbol: SYNGR2
  Gene Name: synaptogyrin 2
  ENSP ID: ENSP00000466032
MESGAYGAAKAGGSFDLRRFLTQPQVVARAVCLLSGPSCGLLVSASSPTSGQSPTRRTCWWGPTL

SEQ ID NO: 85541 - protein, 135 aa, Homo sapiens
  Payload ID: 16996
  Gene Symbol: SYNGR2
  Gene Name: synaptogyrin 2
  ENSP ID: ENSP00000466204
  MOD_RES (1)..(1): Any amino acid
XESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSGCAGLPGLPALQGWRGRLHPELR

SEQ ID NO: 85542 - protein, 113 aa, Homo sapiens
  Payload ID: 16996
  Gene Symbol: SYNGR2
  Gene Name: synaptogyrin 2
  ENSP ID: ENSP00000466942
MESGAYGAAKAGGSFDLRRFLTQPQVVARAVCLEAEDAVSRDRTIALQPGQQEQDSISNNNKNPKGDSSSGRGQHLYTPSGSPLCVPLRRPPALPGPPLPAGLRLDRVLLHLW

SEQ ID NO: 85543 - protein, 275 aa, Homo sapiens
  Payload ID: 16996
  Gene Symbol: SYNGR2
  Gene Name: synaptogyrin 2
  Uniprot ID: O43760
  ENSP ID: ENSP00000467600
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWVGWPGAGSWVKGGGGWGPPPTCTLLCSPCRVCWPPWPTSATRLAWTTSSRITLTPLRTPTLPTPPTQVHLWTTTNSHPSPRTRRPPRATSRPLCTERRLAWEGGQRGPSPLPWTFP

SEQ ID NO: 85544 - protein, 229 aa, Homo sapiens
  Payload ID: 16997
  Gene Symbol: SYNGR3
  Gene Name: synaptogyrin 3
  Uniprot ID: O43761
  ENSP ID: ENSP00000248121
MEGASFGAGRAGAALDPVSFARRPQTLLRVASWVFSIAVFGPIVNEGYVNTDSGPELRCVFNGNAGACRFGVALGLGAFLACAAFLLLDVRFQQISSVRDRRRAVLLDLGFSGLWSFLWFVGFCFLTNQWQRTAPGPATTQAGDAARAAIAFSFFSILSWVALTVKALQRFRLGTDMSLFATEQLSTGASQAYPGYPVGSGVEGTETYQSPPFTETLDTSPKGYQVPAY

SEQ ID NO: 85545 - protein, 177 aa, Homo sapiens
  Payload ID: 16997
  Gene Symbol: SYNGR3
  Gene Name: synaptogyrin 3
  ENSP ID: ENSP00000454756
SFARRPQTLLRVASWPLLRFSCSRDLEAGTGWGRNSPRGRRGLREPRSASPSPAHTPSGLLGREPVPWPPVPAVFSIAVFGPIVNEGYVNTDSGPELRCVFNGNAGACRFGVALGLGAFLACAAFLLLDVRFQQISSVRDRRRAVLLDLGFSGLWSFLWFVGFCFLTNQWQRTAPGP

SEQ ID NO: 85546 - protein, 239 aa, Homo sapiens
  Payload ID: 16997
  Gene Symbol: SYNGR3
  Gene Name: synaptogyrin 3
  ENSP ID: ENSP00000455344
MVSISGPGQAGVLHRRLRAHRQRGLREHRQRPRAALRVQRERGRLPLRRRAGPRSLPRLRRLPAARCALPANQQRPRPPARGVAGPGLLRTLVLPVVRGLLLPHQSVAAHGARAGHDAGGGRGAGRHRLQLLLHPQLGGAHREGPAAVPPGHRHVTLRHRTAEHRGEPGLPRLSGGQRRGGHRDLPEPALHRDPGHQPQRVPGARLLAAGRHRPGLQGHPTNAGPRVSGTSLGSFQLSA

SEQ ID NO: 85547 - protein, 76 aa, Homo sapiens
  Payload ID: 16997
  Gene Symbol: SYNGR3
  Gene Name: synaptogyrin 3
  ENSP ID: ENSP00000455577
MCASSKSAASATAGARCCWTWASQDSGPSCGSWASASSPISGSARRQGRPRRRRGTRRGPPSPSASSPSSAGWRSP

SEQ ID NO: 85548 - protein, 145 aa, Homo sapiens
  Payload ID: 16997
  Gene Symbol: SYNGR3
  Gene Name: synaptogyrin 3
  ENSP ID: ENSP00000481324
MEGASFGAGRAGAALDPVSFARRPQTLLRVASWVFSIAVFGPIVNEGYVNTDSGPELRCVFNGNAGACRFGVALGLGAFLACAAFLLLDVRFQQSGGRGKTPPSPQDWGSWPLFPSHVPVGSDCLVSVMVVRPVRSHSPLSLTGC

SEQ ID NO: 85549 - protein, 234 aa, Homo sapiens
  Payload ID: 16998
  Gene Symbol: SYNGR4
  Gene Name: synaptogyrin 4
  Uniprot ID: O95473
  ENSP ID: ENSP00000344041
MHIPKSLQELANSEAVQFLRRPKTITRVFEGVFSLIVFSSLLTDGYQNKMESPQLHCILNSNSVACSFAVGAGFLAFLSCLAFLVLDTQETRIAGTRFKTAFQLLDFILAVLWAVVWFMGFCFLANQWQHSPPKEFLLGSSSAQAAIAFTFFSILVWIFQAYLAFQDLRNDAPVPYKRFLDEGGMVLTTLPLPSANSPVNMPTTGPNSLSYASSALSPCLTAPKSPRLAMMPDN

SEQ ID NO: 85550 - protein, 74 aa, Homo sapiens
  Payload ID: 16998
  Gene Symbol: SYNGR4
  Gene Name: synaptogyrin 4
  ENSP ID: ENSP00000469430
MESPQLHCILNSNSVACSFAVGAGFLAFLSCLAFLVLDTQETRIAGTRFKTAFQLLDFILADIPGLPGIPGPPK

SEQ ID NO: 85551 - protein, 91 aa, Homo sapiens
  Payload ID: 16998
  Gene Symbol: SYNGR4
  Gene Name: synaptogyrin 4
  ENSP ID: ENSP00000469900
MESPQLHCILNSNSVACSFAVGAGFLAFLSCLAFLVLDTQETRIAGTRFKTAFQLLDFILAVLWAVVWFMGFCFLANQWQHSPPKEFLLGS

SEQ ID NO: 85552 - protein, 146 aa, Homo sapiens
  Payload ID: 16998
  Gene Symbol: SYNGR4
  Gene Name: synaptogyrin 4
  ENSP ID: ENSP00000472198
MESPQLHCILNSNSVACSFAVGAGFLAFLSCLAFLVLDTQETRIAGTRFKTAFQLLDFILAVLWAVVWFMGFCFLANQWQHSPPKEFLLGSSSAQAAIAFTFFSILVWASPQPSPSPDLPSPSQPSARAFLPTDIPGLPGIPGPPK

SEQ ID NO: 85553 - protein, 1295 aa, Homo sapiens
  Payload ID: 16999
  Gene Symbol: SYNJ1
  Gene Name: synaptojanin 1
  Uniprot ID: O43426
  ENSP ID: ENSP00000349903
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQQEQPSG

SEQ ID NO: 85554 - protein, 1264 aa, Homo sapiens
  Payload ID: 16999
  Gene Symbol: SYNJ1
  Gene Name: synaptojanin 1
  ENSP ID: ENSP00000371931
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKAGKLKDGARSVTRTIQNNFFDSSKQEAIDVLLLGNTLNSDLADKARALLTTGSLRASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQQEQPSG

SEQ ID NO: 85555 - protein, 1350 aa, Homo sapiens
  Payload ID: 16999
  Gene Symbol: SYNJ1
  Gene Name: synaptojanin 1
  ENSP ID: ENSP00000371939
MRKRWACWSGSDAPGGCGGGCGRRRRRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQQEQPSG

SEQ ID NO: 85556 - protein, 131 aa, Homo sapiens
  Payload ID: 16999
  Gene Symbol: SYNJ1
  Gene Name: synaptojanin 1
  ENSP ID: ENSP00000387868
  MOD_RES (1)..(1): Any amino acid
XAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQEQPSG

SEQ ID NO: 85557 - protein, 187 aa, Homo sapiens
  Payload ID: 16999
  Gene Symbol: SYNJ1
  Gene Name: synaptojanin 1
  ENSP ID: ENSP00000388869
  MOD_RES (1)..(1): Any amino acid
XPPRPVAPPTRPAPPQRPPPPSGARSPAPTRKEFGAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQQEQPSG

SEQ ID NO: 85558 - protein, 1612 aa, Homo sapiens
  Payload ID: 16999
  Gene Symbol: SYNJ1
  Gene Name: synaptojanin 1
  ENSP ID: ENSP00000409667
MRKRWACWSGSDAPGGCGGGCGRRRRRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 85559 - protein, 178 aa, Homo sapiens
  Payload ID: 16999
  Gene Symbol: SYNJ1
  Gene Name: synaptojanin 1
  ENSP ID: ENSP00000412707
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDW

SEQ ID NO: 85560 - protein, 695 aa, Homo sapiens
  Payload ID: 16999
  Gene Symbol: SYNJ1
  Gene Name: synaptojanin 1
  ENSP ID: ENSP00000413649
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKAGKLKDGARSVTRTIQNNFFDSSKQEAIDVLLLGNTLNSDLADKARALLTTGSLRASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKER

SEQ ID NO: 85561 - protein, 1526 aa, Homo sapiens
  Payload ID: 16999
  Gene Symbol: SYNJ1
  Gene Name: synaptojanin 1
  ENSP ID: ENSP00000487560
MAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKAGKLKDGARSVTRTIQNNFFDSSKQEAIDVLLLGNTLNSDLADKARALLTTGSLRASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 85562 - protein, 1496 aa, Homo sapiens
  Payload ID: 17000
  Gene Symbol: SYNJ2
  Gene Name: synaptojanin 2
  Uniprot ID: O15056
  ENSP ID: ENSP00000347792
MALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 85563 - protein, 581 aa, Homo sapiens
  Payload ID: 17000
  Gene Symbol: SYNJ2
  Gene Name: synaptojanin 2
  ENSP ID: ENSP00000356079
MQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 85564 - protein, 136 aa, Homo sapiens
  Payload ID: 17000
  Gene Symbol: SYNJ2
  Gene Name: synaptojanin 2
  ENSP ID: ENSP00000356080
  MOD_RES (1)..(1): Any amino acid
XGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFF

SEQ ID NO: 85565 - protein, 839 aa, Homo sapiens
  Payload ID: 17000
  Gene Symbol: SYNJ2
  Gene Name: synaptojanin 2
  ENSP ID: ENSP00000356089
MGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 85566 - protein, 92 aa, Homo sapiens
  Payload ID: 17000
  Gene Symbol: SYNJ2
  Gene Name: synaptojanin 2
  ENSP ID: ENSP00000411202
MFLYASGPAPPAGTCRWGGQGGTSLSFLVLVTGCTSVGRIPDAEIYKITATDFYPLQEEAKEEERLIALKKILSSGVFYFSWPNDGSRFDLT

SEQ ID NO: 85567 - protein, 165 aa, Homo sapiens
  Payload ID: 17000
  Gene Symbol: SYNJ2
  Gene Name: synaptojanin 2
  ENSP ID: ENSP00000436657
  MOD_RES (1)..(1): Any amino acid
XVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKVRPGCPLHSWAGRQVAMVER

SEQ ID NO: 85568 - protein, 145 aa, Homo sapiens
  Payload ID: 17001
  Gene Symbol: SYNJ2BP
  Gene Name: synaptojanin 2 binding protein
  Uniprot ID: P57105
  ENSP ID: ENSP00000256366
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLQVQNGPIGHRGEGDPSGIPIFMVLVPVFALTMVAAWAFMRYRQQL

SEQ ID NO: 85569 - protein, 318 aa, Homo sapiens
  Payload ID: 17002
  Gene Symbol: SYCE1
  Gene Name: synaptonemal complex central element protein 1
  ENSP ID: ENSP00000303978
MAGRSLTSKAEPTAGAVDRAEKAGGQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 85570 - protein, 351 aa, Homo sapiens
  Payload ID: 17002
  Gene Symbol: SYCE1
  Gene Name: synaptonemal complex central element protein 1
  Uniprot ID: Q8N0S2
  ENSP ID: ENSP00000341282
MAGRSLTSKAEPTAGAVDRAEKAGGQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVASPKPLKGERPGAAHQAGPDVLIGQEDTLHPDLSPRGFQEIKELF

SEQ ID NO: 85571 - protein, 282 aa, Homo sapiens
  Payload ID: 17002
  Gene Symbol: SYCE1
  Gene Name: synaptonemal complex central element protein 1
  Uniprot ID: Q8N0S2
  ENSP ID: ENSP00000357503
MEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 85572 - protein, 124 aa, Homo sapiens
  Payload ID: 17002
  Gene Symbol: SYCE1
  Gene Name: synaptonemal complex central element protein 1
  ENSP ID: ENSP00000411779
MAGLCYRRQPSSACGRGGLRGGSRGASRVCVRPALCYGAPGSSLRVAAAGAAGSGWRRAAGPGERGLEDEEDWVPGGNRTGSASTATVRGLRALDPRAACASVSGWVAPSVPWGCCGPRPGWAR

SEQ ID NO: 85573 - protein, 242 aa, Homo sapiens
  Payload ID: 17003
  Gene Symbol: SYCE1L
  Gene Name: synaptonemal complex central element protein 1-like
  Uniprot ID: A8MT33
  ENSP ID: ENSP00000367911
MAGKLKPLNVEAPEATEEAEGQAKSLKTEDLLAMVIKLQKEGSLEPQIEDLISRINDLQQAKKKSSEELRETHSLWEALHRELDSLNGEKVHLEEVLGKKQEALRILQMHCQEKESEAQRLDVRGQLEDLMGQHKDLWEFHMLEQRLAREIRALERSKEQLLSERRLVRAKLREVERRLHSPPEVEGAMAVNDGLKAELEIFGEQVRSAPEVGAGEGEAGPELPRARDEEDPEPPVAAPDAL

SEQ ID NO: 85574 - protein, 24 aa, Homo sapiens
  Payload ID: 17003
  Gene Symbol: SYCE1L
  Gene Name: synaptonemal complex central element protein 1-like
  ENSP ID: ENSP00000454349
IFGEQVRSAPEVGAGEGEPPAGRT

SEQ ID NO: 85575 - protein, 218 aa, Homo sapiens
  Payload ID: 17004
  Gene Symbol: SYCE2
  Gene Name: synaptonemal complex central element protein 2
  Uniprot ID: Q6PIF2
  ENSP ID: ENSP00000293695
MERQGVDVPHVKCKDQEPQPLGESKEHPRWEENCEEEAGGGPASASCQLTVLEGKSGLYFSSLDSSIDILQKRAQELIENINKSRQKDHALMTNFRNSLKTKVSDLTEKLEERIYQIYNDHNKIIQEKLQEFTQKMAKISHLETELKQVCHSVETVYKDLCLQPEQSLRLRWGPDHSRGKSPPRPGNSQPPDVFVSSVAETTSQATASEVQTNRDGEC

SEQ ID NO: 85576 - protein, 54 aa, Homo sapiens
  Payload ID: 17004
  Gene Symbol: SYCE2
  Gene Name: synaptonemal complex central element protein 2
  ENSP ID: ENSP00000466359
  MOD_RES (1)..(1): Any amino acid
XKDLCLQPESLRLRWGPDHSRGKSPPRPGNSQPPDVFVSSVAETTSQVVTSKPA

SEQ ID NO: 85577 - protein, 88 aa, Homo sapiens
  Payload ID: 17005
  Gene Symbol: SYCE3
  Gene Name: synaptonemal complex central element protein 3
  Uniprot ID: A1L190
  ENSP ID: ENSP00000385122
MDDADPEERNYDNMLKMLSDLNKDLEKLLEEMEKISVQATWMAYDMVVMRTNPTLAESMRRLEDAFVNCKEEMEKNWQELLHETKQRL

SEQ ID NO: 85578 - protein, 88 aa, Homo sapiens; identical to SEQ ID NO: 85577
  Payload ID: 17005
  Gene Symbol: SYCE3
  Gene Name: synaptonemal complex central element protein 3
  Uniprot ID: A1L190
  ENSP ID: ENSP00000385480

SEQ ID NO: 85579 - protein, 976 aa, Homo sapiens
  Payload ID: 17006
  Gene Symbol: SYCP1
  Gene Name: synaptonemal complex protein 1
  Uniprot ID: Q15431
  ENSP ID: ENSP00000358531
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 85580 - protein, 976 aa, Homo sapiens; identical to SEQ ID NO: 85579
  Payload ID: 17006
  Gene Symbol: SYCP1
  Gene Name: synaptonemal complex protein 1
  Uniprot ID: Q15431
  ENSP ID: ENSP00000358535

SEQ ID NO: 85581 - protein, 792 aa, Homo sapiens
  Payload ID: 17006
  Gene Symbol: SYCP1
  Gene Name: synaptonemal complex protein 1
  ENSP ID: ENSP00000410011
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKK

SEQ ID NO: 85582 - protein, 976 aa, Homo sapiens; identical to SEQ ID NO: 85579
  Payload ID: 17006
  Gene Symbol: SYCP1
  Gene Name: synaptonemal complex protein 1
  Uniprot ID: Q15431
  ENSP ID: ENSP00000480997

SEQ ID NO: 85583 - protein, 951 aa, Homo sapiens
  Payload ID: 17006
  Gene Symbol: SYCP1
  Gene Name: synaptonemal complex protein 1
  ENSP ID: ENSP00000482532
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 85584 - protein, 1530 aa, Homo sapiens
  Payload ID: 17007
  Gene Symbol: SYCP2
  Gene Name: synaptonemal complex protein 2
  Uniprot ID: Q9BX26
  ENSP ID: ENSP00000350162
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLVIHDVSDEGKKQVVESFVPRICSLVIDSRVNICIQQEIIKKMNAMLDKMPQDARKILSNQEMLILMSSMGERILDAGDYDLQVGIVEALCRMTTEKQRQELAHQWFSMDFIAKAFKRIKDSEFETDCRIFLNLVNGMLGDKRRVFTFPCLSAFLDKYELQIPSDEKLEEFWIDFNLGSQTLSFYIAGDNDDHQWEAVTVPEEKVQIYSIEVRESKKLLTIILKNTVKISKREGKELLLYFDASLEITNVTQKIFGATKHRESIRKQGISVAKTSLHILFDASGSQILVPESQISPVGEELVSLKEKSKSPKEFAKPSKYIKNSDKGNRNNSQLEKTTPSKRKMSEASMIVSGADRYTMRSPVLFSNTSIPPRRRRIKPPLQMTSSAEKPSVSQTSENRVDNAASLKSRSSEGRHRRDNIDKHIKTAKCVENTENKNVEFPNQNFSELQDVIPDSQAAEKRDHTILPGVLDNICGNKIHSKWACWTPVTNIELCNNQRASTSSGDTLNQDIVINKKLTKQKSSSSISDHNSEGTGKVKYKKEQTDHIKIDKAEVEVCKKHNQQQNHPKYSGQKNTENAKQSDWPVESETTFKSVLLNKTIEESLIYRKKYILSKDVNTATCDKNPSASKNVQSHRKAEKELTSELNSWDSKQKKMREKSKGKEFTNVAESLISQINKRYKTKDDIKSTRKLKESLINSGFSNKPVVQLSKEKVQKKSYRKLKTTFVNVTSECPVNDVYNFNLNGADDPIIKLGIQEFQATAKEACADRSIRLVGPRNHDELKSSVKTKDKKIITNHQKKNLFSDTETEYRCDDSKTDISWLREPKSKPQLIDYSRNKNVKNHKSGKSRSSLEKGQPSSKMTPSKNITKKMDKTIPEGRIRLPRKATKTKKNYKDLSNSESECEQEFSHSFKENIPVKEENIHSRMKTVKLPKKQQKVFCAETEKELSKQWKNSSLLKDAIRDNCLDLSPRSLSGSPSSIEVTRCIEKITEKDFTQDYDCITKSISPYPKTSSLESLNSNSGVGGTIKSPKNNEKNFLCASESCSPIPRPLFLPRHTPTKSNTIVNRKKISSLVLTQETQNSNSYSDVSSYSSEERFMEIESPHINENYIQSKREESHLASSLSKSSEGREKTWFDMPCDATHVSGPTQHLSRKRIYIEDNLSNSNEVEMEEKGERRANLLPKKLCKIEDADHHIHKMSESVSSLSTNDFSIPWETWQNEFAGIEMTYETYERLNSEFKRRNNIRHKMLSYFTTQSWKTAQQHLRTMNHQSQDSRIKKLDKFQFIIIEELENFEKDSQSLKDLEKEFVDFWEKIFQKFSAYQKSEQQRLHLLKTSLAKSVFCNTDSEETVFTSEMCLMKEDMKVLQDRLLKDMLEEELLNVRRELMSVFMSHERNANV

SEQ ID NO: 85585 - protein, 1530 aa, Homo sapiens; identical to SEQ ID NO: 85584
  Payload ID: 17007
  Gene Symbol: SYCP2
  Gene Name: synaptonemal complex protein 2
  Uniprot ID: Q9BX26
  ENSP ID: ENSP00000360040

SEQ ID NO: 85586 - protein, 118 aa, Homo sapiens
  Payload ID: 17007
  Gene Symbol: SYCP2
  Gene Name: synaptonemal complex protein 2
  ENSP ID: ENSP00000399300
MPIRPDLQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKD

SEQ ID NO: 85587 - protein, 1023 aa, Homo sapiens
  Payload ID: 17007
  Gene Symbol: SYCP2
  Gene Name: synaptonemal complex protein 2
  ENSP ID: ENSP00000402456
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLVIHDVSDEGKKQVVESFVPRICSLVIDSRVNICIQQEIIKKMNAMLDKMPQDARKILSNQEMLILMSSMGERILDAGDYDLQVGIVEALCRMTTEKQRQELAHQWFSMDFIAKAFKRIKDSEFETDCRIFLNLVNGMLGDKRRVFTFPCLSAFLDKYELQIPSDEKLEEFWIDFNLGSQTLSFYIAGDNDDHQWEAVTVPEEKVQIYSIEVRESKKLLTIILKNTVKISKREGKELLLYFDASLEITNVTQKIFGATKHRESIRKQGISVAKTSLHILFDASGSQILVPESQISPVGEELVSLKEKSKSPKEFAKPSKYIKNSDKGNRNNSQLEKTTPSKRKMSEASMIVSGADRYTMRSPVLFSNTSIPPRRRRIKPPLQMTSSAEKPSVSQTSENRVDNAASLKSRSSEGRHRRDNIDKHIKTAKCVENTENKNVEFPNQNFSELQDVIPDSQAAEKRDHTILPGVLDNICGNKIHSKWACWTPVTNIELCNNQRASTSSGDTLNQDIVINKKLTKQKSSSSISDHNSEGTGKVKYKKEQTDHIKIDKAEVEVCKKHNQQQNHPKYSGQKNTENAKQSDWPVESETTFKSVLLNKTIEESLIYRKKYILSKDVNTATCDKNPSASKNVQSHRKAEKELTSELNSWDSKQKKMREKSKGKEFTNVAESLISQINKRYKTKDDIKSTRKLKESLINSGFSNKPVVQLSKEKVQKKSYRKLKTTFVNVTSECPVNDVYNFNLNGADDPIIKLGIQEFQATAKEACADRSIRLVGPRNHDELKSSVKTKDKKIITNHQKKNLFSDTETEYRCDDSKTDISWLREPKSKPQLIDYSRNKNVKNHKSGKSRSSLEKGQPSSKMTPSKNITKKMDKTIPEGRIRLPRKATKTKK

SEQ ID NO: 85588 - protein, 208 aa, Homo sapiens
  Payload ID: 17007
  Gene Symbol: SYCP2
  Gene Name: synaptonemal complex protein 2
  ENSP ID: ENSP00000404358
EKTWFDMPCDATHVSVSESVSSLSTNDFSIPWETWQNEFAGIEMTYETYERLNSEFKRRNNIRHKMLSYFTTQSWKTAQQHLRTMNHQSQDSRIKKLDKFQFIIIEELENFEKDSQSLKDLEKEFVDFWEKIFQKFSAYQKSEQQRLHLLKTSLAKSVFCNTDSEETVFTSEMCLMKEDMKVLQDRLLKDMLEEELLNVRRELMSVFM

SEQ ID NO: 85589 - protein, 812 aa, Homo sapiens [sequence omitted]

SEQ ID NO: 85590 - protein, 291 aa, Homo sapiens
  Payload ID: 17008
  Gene Symbol: SYCP2L
  Gene Name: synaptonemal complex protein 2-like
  Uniprot ID: Q5T4T6
  ENSP ID: ENSP00000340320
MQAKNKDALQPIKEDRTGKAQDDAFWLQSLITDAFHDKGFQKIKEYFQQKESHFPQKYNRLLLYRLDRSINKELDKNEFQSVSLLLKCIQRFLVDGLKEDEPLLIRQGLIPKLVSWFERTTGILTSEGLASDTSLICVIEDFFDTALIISRSSSEGKIQMLDSFLLSLGFLVTEKTVNHLLQQEGLKTFNCILHAVPREERKKFPLSEGMCHLMKDLARTLLTVGDYDQQVAISEALCRLTIKKSRDELVHKWFDDEVIAEAFKEIKDREFETDSRRFLNHLNNRLGDQRR

SEQ ID NO: 85591 - protein, 109 aa, Homo sapiens
  Payload ID: 17008
  Gene Symbol: SYCP2L
  Gene Name: synaptonemal complex protein 2-like
  ENSP ID: ENSP00000417870
VSWFERTTGILTSEGLASDTSLICVIEDFFDTALIISRSSSEGKIQMLDSFLLSLGFLVTEKTVNHLLQQEGLKTFNCILHAVPREERKKFPLSEGMCHLMTVDVFSIT

SEQ ID NO: 85592 - protein, 811 aa, Homo sapiens
  Payload ID: 17008
  Gene Symbol: SYCP2L
  Gene Name: synaptonemal complex protein 2-like
  ENSP ID: ENSP00000440676
TQKNKDALQPIKEDRTGKAQDDAFWLQSLITDAFHDKGFQKIKEYFQQKESHFPQKYNRLLLYRLDRSINKELDKNEFQSVSLLLKCIQRFLVDGLKEDEPLLIRQGLIPKLVSWFERTTGILTSEGLASDTSLICVIEDFFDTALIISRSSSEGKIQMLDSFLLSLGFLVTEKTVNHLLQQEGLKTFNCILHAVPREERKKFPLSEGMCHLMKDLARTLLTVGDYDQQVAISEALCRLTIKKSRDELVHKWFDDEVIAEAFKEIKDREFETDSRRFLNHLNNRLGDQRRVYSFPCIAAFADEHEMRKPADEKLEKFWIDFNLGSQSVTFYIDNAENTLWDSVTLPKEAVMNFSITETEKIKIFIIYLKKPMIISYKEVMKIEIHFDLQFNISQVSIQALGEDKQMLPDQTKISSELFSKSDKEDRESPSGLERETEQAEESTNMVEFMSAEDDRCLITLHLNDQSEPPVIGEPASDSHLQPVPPFGVPDFPQQPKSHYRKHLFSESNQDSSTSELSWTSNQKKKSLKSYSSRKKTRTRSNLRILPVFPPSSGSGHEKDQAKLLSPSEKEIPEQNNTTSPKTSEQKFQDSFAFLTAEDSAQKTELQDPHSLSELSSLKHSEDEEKPKIVNQESLTESTSLKHKLRNLEDKDIPEGSFAKSQQSRLEEEVAPGSPFSITEERELPEGISTSSLEVVPENLNGSAILPTFENFTKKRKRKYELRYRKRPFNSENAKKAPDCLIKLLNQMQLFRLNKLERFQNLVLQELSSLKQDIQALEHLEKEVLEFWGKQSADLQSFCDLQVLRFNSTQTS

SEQ ID NO: 85593 - protein, 236 aa, Homo sapiens
  Payload ID: 17009
  Gene Symbol: SYCP3
  Gene Name: synaptonemal complex protein 3
  Uniprot ID: Q8IZU3
  ENSP ID: ENSP00000266743
MVSSGKKYSRKSGKPSVEDQFTRAYDFETEDKKDLSGSEEDVIEGKTAVIEKRRKKRSSAGVVEDMGGEVQNMLEGVGVDINKALLAKRKRLEMYTKASLKTSNQKIEHVWKTQQDQRQKLNQEYSQQFLTLFQQWDLDMQKAEEQEEKILNMFRQQQKILQQSRIVQSQRLKTIKQLYEQFIKSMEELEKNHDNLLTGAQNEFKKEMAMLQKKIMMETQQQEIASVRKSLQSMLF

SEQ ID NO: 85594 - protein, 236 aa, Homo sapiens; identical to SEQ ID NO: 85593
  Payload ID: 17009
  Gene Symbol: SYCP3
  Gene Name: synaptonemal complex protein 3
  Uniprot ID: Q8IZU3
  ENSP ID: ENSP00000376655

SEQ ID NO: 85595 - protein, 236 aa, Homo sapiens; identical to SEQ ID NO: 85593
  Payload ID: 17009
  Gene Symbol: SYCP3
  Gene Name: synaptonemal complex protein 3
  Uniprot ID: Q8IZU3
  ENSP ID: ENSP00000376658

SEQ ID NO: 85596 - protein, 313 aa, Homo sapiens
  Payload ID: 17010
  Gene Symbol: SYP
  Gene Name: synaptophysin
  Uniprot ID: P08247
  ENSP ID: ENSP00000263233
MLLLADMDVVNQLVAGGQFRVVKEPLGFVKVLQWVFAIFAFATCGSYSGELQLSVDCANKTESDLSIEVEFEYPFRLHQVYFDAPTCRGGTTKVFLVGDYSSSAEFFVTVAVFAFLYSMGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 85597 - protein, 40 aa, Homo sapiens
  Payload ID: 17010
  Gene Symbol: SYP
  Gene Name: synaptophysin
  ENSP ID: ENSP00000365480
MLLLADMDVVNQLVAGGQFRVVKEPLGFVKVLQWAAPSVL

SEQ ID NO: 85598 - protein, 313 aa, Homo sapiens; identical to SEQ ID NO: 85596
  Payload ID: 17010
  Gene Symbol: SYP
  Gene Name: synaptophysin
  Uniprot ID: P08247
  ENSP ID: ENSP00000418169

SEQ ID NO: 85599 - protein, 203 aa, Homo sapiens
  Payload ID: 17010
  Gene Symbol: SYP
  Gene Name: synaptophysin
  ENSP ID: ENSP00000418387
  MOD_RES (1)..(1): Any amino acid
XADMDVVNQLVAGGQFRVVKEPLGFVKVLQWDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 85600 - protein, 118 aa, Homo sapiens
  Payload ID: 17010
  Gene Symbol: SYP
  Gene Name: synaptophysin
  ENSP ID: ENSP00000418987
MLLLADMDVVNQLVAGGQFRVVKEPLGFVKVLQWVFAIFAFATCGSYSGELQLSVDCANKTESDLSIEVEFEYPFRCAPTLGYQQTWERKGQGGTGQYLPPQVAPAQLPPRGYIHWDH

SEQ ID NO: 85601 - protein, 118 aa, Homo sapiens; identical to SEQ ID NO: 85600
  Payload ID: 17010
  Gene Symbol: SYP
  Gene Name: synaptophysin
  ENSP ID: ENSP00000420774

SEQ ID NO: 85602 - protein, 259 aa, Homo sapiens
  Payload ID: 17011
  Gene Symbol: SYPL1
  Gene Name: synaptophysin-like 1
  Uniprot ID: Q16563
  ENSP ID: ENSP00000011473
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 85603 - protein, 241 aa, Homo sapiens
  Payload ID: 17011
  Gene Symbol: SYPL1
  Gene Name: synaptophysin-like 1
  Uniprot ID: Q16563
  ENSP ID: ENSP00000388336
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 85604 - protein, 148 aa, Homo sapiens
  Payload ID: 17011
  Gene Symbol: SYPL1
  Gene Name: synaptophysin-like 1
  ENSP ID: ENSP00000417473
  MOD_RES (1)..(1): Any amino acid
XNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVMEFRYVAQTGVQWHDLGTLQPPPPGFK

SEQ ID NO: 85605 - protein, 224 aa, Homo sapiens
  Payload ID: 17011
  Gene Symbol: SYPL1
  Gene Name: synaptophysin-like 1
  ENSP ID: ENSP00000419070
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVMEFRYVAQTGVQWHDLGTLQPPPPGFK

SEQ ID NO: 85606 - protein, 135 aa, Homo sapiens
  Payload ID: 17011
  Gene Symbol: SYPL1
  Gene Name: synaptophysin-like 1
  ENSP ID: ENSP00000489167
WIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMINGNGLCCYTCCHFFVVGEHFSLG

SEQ ID NO: 85607 - protein, 272 aa, Homo sapiens
  Payload ID: 17012
  Gene Symbol: SYPL2
  Gene Name: synaptophysin-like 2
  Uniprot ID: Q5VXT5
  ENSP ID: ENSP00000358888
MSSTESAGRTADKSPRQQVDRLLVGLRWRRLEEPLGFIKVLQWLFAIFAFGSCGSYSGETGAMVRCNNEAKDVSSIIVAFGYPFRLHRIQYEMPLCDEESSSKTMHLMGDFSAPAEFFVTLGIFSFFYTMAALVIYLRFHNLYTENKRFPLVDFCVTVSFTFFWLVAAAAWGKGLTDVKGATRPSSLTAAMSVCHGEEAVCSAGATPSMGLANISVLFGFINFFLWAGNCWFVFKETPWHGQGQGQDQDQDQDQGQGPSQESAAEQGAVEKQ

SEQ ID NO: 85608 - protein, 903 aa, Homo sapiens
  Payload ID: 17013
  Gene Symbol: SYNPO
  Gene Name: synaptopodin
  Uniprot ID: Q8N3V7
  ENSP ID: ENSP00000302139
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQDRRESLPTSPPWTPGASRPPSSLDGWVSPGPWEPGRGSSMSSPPPLPPPPPMSPSWSERSVSPLRPETEARPPSRQLQALLARNIINAARRKSASPRSAGAENPRPFSPPRAPPPPPPPPPPPPRMRSPQPARPGSAAVPGAAFAPIPRSPLPAGPSSCTSPRSPLPAPPRPFLYRRSPTDSDVSLDSEDSGAKSPGILGYNICPRGWNGSLRLKRGSLPAEASCTT

SEQ ID NO: 85609 - protein, 929 aa, Homo sapiens
  Payload ID: 17013
  Gene Symbol: SYNPO
  Gene Name: synaptopodin
  Uniprot ID: Q8N3V7
  ENSP ID: ENSP00000377789
MLGPHLPPPPLAPSEGRPTPCAFQIPDGSYRCLALEAEESSGEEGLQGEVGPTDLEEDEGVSRSGDDSACRVTQGTPQLPKALGIQPPSCSREEQGASQHDDRASQDWDVVKAGQMMTASPSPGPGPRVAQKPALGRSTSLTEKDLKEAKARSQQIAAQLTTPPSSNSRGVQLFNRRRQRVNEFTLESHGQRGQKPSQESLRVLPSSLPGHAPGLSLSSTSLPEPGPPRHPSPQSPDRGVPGHSMEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQVWKPSFCFK

SEQ ID NO: 85610 - protein, 929 aa, Homo sapiens; identical to SEQ ID NO: 85609
  Payload ID: 17013
  Gene Symbol: SYNPO
  Gene Name: synaptopodin
  Uniprot ID: Q8N3V7
  ENSP ID: ENSP00000428378

SEQ ID NO: 85611 - protein, 685 aa, Homo sapiens
  Payload ID: 17013
  Gene Symbol: SYNPO
  Gene Name: synaptopodin
  Uniprot ID: Q8N3V7
  ENSP ID: ENSP00000429268
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQVWKPSFCFK

SEQ ID NO: 85612 - protein, 1261 aa, Homo sapiens
  Payload ID: 17014
  Gene Symbol: SYNPO2
  Gene Name: synaptopodin 2
  Uniprot ID: Q9UMS6
  ENSP ID: ENSP00000306015
MGTGDFICISMTGGAPWGFRLQGGKEQKQPLQVAKIRNQSKASGSGLCEGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQRAPQMPDSQRGRVAEELILREKVEAVQPGPVVELQLSLSQERHKGASGPLVALPGAEKSKSPDPDPNLSHDRIVHINSIPTNEKADPFLRSSKIIQISSGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGTSETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPVAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQESGRSLSLPGRSVPPPISTSPWVYQPTYSYSSKPTDGLEKANKRPTPWEAAAKSPLGLVDDAFQPRNIQESIVANVVSAARRKVLPGPPEDWNERLSYIPQTQKAYMGSCGRQEYNVTANNNMSTTSQYGSQLPYAYYRQASRNDSAIMSMETRSDYCLPVADYNYNPHPRGWRRQT

SEQ ID NO: 85613 - protein, 1109 aa, Homo sapiens
  Payload ID: 17014
  Gene Symbol: SYNPO2
  Gene Name: synaptopodin 2
  Uniprot ID: Q9UMS6
  ENSP ID: ENSP00000390965
MGTGDFICISMTGGAPWGFRLQGGKEQKQPLQVAKIRNQSKASGSGLCEGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQRAPQMPDSQRGRVAEELILREKVEAVQPGPVVELQLSLSQERHKGASGPLVALPGAEKSKSPDPDPNLSHDRIVHINSIPTNEKADPFLRSSKIIQISSGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGTSETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPVAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQVKCKSGIHSQDIIRTYFPAYLSSST

SEQ ID NO: 85614 - protein, 1093 aa, Homo sapiens
  Payload ID: 17014
  Gene Symbol: SYNPO2
  Gene Name: synaptopodin 2
  Uniprot ID: Q9UMS6
  ENSP ID: ENSP00000395143
MGTGDFICISMTGGAPWGFRLQGGKEQKQPLQVAKIRNQSKASGSGLCEGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQRAPQMPDSQRGRVAEELILREKVEAVQPGPVVELQLSLSQERHKGASGPLVALPGAEKSKSPDPDPNLSHDRIVHINSIPTNEKADPFLRSSKIIQISSGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGTSETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPVAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQVWKPSVVEE

SEQ ID NO: 85615 - protein, 123 aa, Homo sapiens
  Payload ID: 17014
  Gene Symbol: SYNPO2
  Gene Name: synaptopodin 2
  ENSP ID: ENSP00000412623
MGTGDFICISMTGGAPWGFRLQGGKEQKQPLQVAKIRNQSKASGSGLCEGDEVVSINGNPCADLTYPEVIKLMESITDSLQMLIKRRVGAPFLFLEDQSHPPFLHLLGYTSLLIVTLVNQPMD

SEQ ID NO: 85616 - protein, 1155 aa, Homo sapiens
  Payload ID: 17014
  Gene Symbol: SYNPO2
  Gene Name: synaptopodin 2
  ENSP ID: ENSP00000425496
  MOD_RES (1)..(1): Any amino acid
XGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQRAPQMPDSQRGRVAEELILREKVEAVQPGPVVELQLSLSQERHKGASGPLVALPGAEKSKSPDPDPNLSHDRIVHINSIPTNEKADPFLRSSKIIQISSGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGTSETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPVAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSESGRSLSLPGRSVPPPISTSPWVYQPTYSYSSKPTDGLEKANKRPTPWEAAAKSPLGLVDDAFQPRNIQESIVANVVSAARRKVLPGPPEDWNERLSYIPQTQKAYMGSCGRQEYNVTANNNMSTTSQYGSQLPYAYYRQASRNDSAIMSMETRSDYCLPVADYNYNPHPRGWRRQT

SEQ ID NO: 85617 - protein, 1230 aa, Homo sapiens
  Payload ID: 17014
  Gene Symbol: SYNPO2
  Gene Name: synaptopodin 2
  Uniprot ID: Q9UMS6
  ENSP ID: ENSP00000484885
MVTQIRNQSKASGSGLCEGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQRAPQMPDSQRGRVAEELILREKVEAVQPGPVVELQLSLSQERHKGASGPLVALPGAEKSKSPDPDPNLSHDRIVHINSIPTNEKADPFLRSSKIIQISSGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGTSETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPVAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQESGRSLSLPGRSVPPPISTSPWVYQPTYSYSSKPTDGLEKANKRPTPWEAAAKSPLGLVDDAFQPRNIQESIVANVVSAARRKVLPGPPEDWNERLSYIPQTQKAYMGSCGRQEYNVTANNNMSTTSQYGSQLPYAYYRQASRNDSAIMSMETRSDYCLPVADYNYNPHPRGWRRQT

SEQ ID NO: 85618 - protein, 753 aa, Homo sapiens
  Payload ID: 17015
  Gene Symbol: SYNPO2L
  Gene Name: synaptopodin 2-like
  Uniprot ID: Q9H987
  ENSP ID: ENSP00000361964
METFEPISQEPLSQASYDKAPDPVPELQDSFYAELQRAESLQEKSIKEAKTKCRTIASLLTAAPNPHSKGVLMFKKRRQRAKKYTLVSFGAAAGTGAEEEDGVPPTSESELDEEAFSDARSLTNQSDWDSPYLDMELARAGSRASEGQGSGLGGQLSEVSGRGVQLFEQQRQRADSSTQELARVEPAAMLNGEGLQSPPRAQSAPPEAAVLPPSPLPAPVASPRPFQPGGGAPTPAPSIFNRSARPFTPGLQGQRPTTTSVIFRPLAPKRANDSLGGLSPAPPPFLSSQGPTPLPSFTSGVPSHAPVSGSPSTPRSSGPVTATSSLYIPAPSRPVTPGGAPEPPAPPSAAAMTSTASIFLSAPLRPSARPEAPAPGPGAPEPPSAREQRISVPAARTGILQEARRRGTRKQMFRPGKEETKNSPNPELLSLVQNLDEKPRAGGAESGPEEDALSLGAEACNFMQPVGARSYKTLPHVTPKTPPPMAPKTPPPMTPKTPPPVAPKPPSRGLLDGLVNGAASSAGIPEPPRLQGRGGELFAKRQSRADRYVVEGTPGPGLGPRPRSPSPTPSLPPSWKYSPNIRAPPPIAYNPLLSPFFPQAARTLPKAQSQGPRATPKQGIKALDFMRHQPYQLKTAMFCFDEVPPTPGPIASGSPKTARVQEIRRFSTPAPQPTAEPLAPTVLAPRAATTLDEPIWRTELASAPVPSPAPPPEAPRGLGASPSSCGFQVARPRFSATRTGLQAHVWRPGAGHQ

SEQ ID NO: 85619 - protein, 977 aa, Homo sapiens
  Payload ID: 17015
  Gene Symbol: SYNPO2L
  Gene Name: synaptopodin 2-like
  Uniprot ID: Q9H987
  ENSP ID: ENSP00000378289
MGAEEEVLVTLSGGAPWGFRLHGGAEQRKPLQVSKIRRRSQAGRAGLRERDQLLAINGVSCTNLSHASAMSLIDASGNQLVLTVQRLADEGPVQSPSPHELQVLSPLSPLSPEPPGAPVPQPLQPGSLRSPPDSEAYYGETDSDADGPATQEKPRRPRRRGPTRPTPPGAPPDEVYLSDSPAEPAPTIPGPPSQGDSRVSSPSWEDGAALQPPPAEALLLPHGPLRPGPHLIPMVGPVPHPVAEDLTTTYTQKAKQAKLQRAESLQEKSIKEAKTKCRTIASLLTAAPNPHSKGVLMFKKRRQRAKKYTLVSFGAAAGTGAEEEDGVPPTSESELDEEAFSDARSLTNQSDWDSPYLDMELARAGSRASEGQGSGLGGQLSEVSGRGVQLFEQQRQRADSSTQELARVEPAAMLNGEGLQSPPRAQSAPPEAAVLPPSPLPAPVASPRPFQPGGGAPTPAPSIFNRSARPFTPGLQGQRPTTTSVIFRPLAPKRANDSLGGLSPAPPPFLSSQGPTPLPSFTSGVPSHAPVSGSPSTPRSSGPVTATSSLYIPAPSRPVTPGGAPEPPAPPSAAAMTSTASIFLSAPLRPSARPEAPAPGPGAPEPPSAREQRISVPAARTGILQEARRRGTRKQMFRPGKEETKNSPNPELLSLVQNLDEKPRAGGAESGPEEDALSLGAEACNFMQPVGARSYKTLPHVTPKTPPPMAPKTPPPMTPKTPPPVAPKPPSRGLLDGLVNGAASSAGIPEPPRLQGRGGELFAKRQSRADRYVVEGTPGPGLGPRPRSPSPTPSLPPSWKYSPNIRAPPPIAYNPLLSPFFPQAARTLPKAQSQGPRATPKQGIKALDFMRHQPYQLKTAMFCFDEVPPTPGPIASGSPKTARVQEIRRFSTPAPQPTAEPLAPTVLAPRAATTLDEPIWRTELASAPVPSPAPPPEAPRGLGASPSSCGFQVARPRFSATRTGLQAHVWRPGAGHQ

SEQ ID NO: 85620 - protein, 115 aa, Homo sapiens
  Payload ID: 17015
  Gene Symbol: SYNPO2L
  Gene Name: synaptopodin 2-like
  ENSP ID: ENSP00000475768
MSLIDASGNQLVLTVQRLADEGPVQSPSPHELQVLSPLSPLSPEPPGAPVPQPLQPGSLRSPPDSEAYYGETDSDADGPATQEKPRRPRRRGPTRPTPPGAPPDEVYLSDSPAEP

SEQ ID NO: 85621 - protein, 265 aa, Homo sapiens
  Payload ID: 17016
  Gene Symbol: SYNPR
  Gene Name: synaptoporin
  Uniprot ID: Q8TBG9
  ENSP ID: ENSP00000295894
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 85622 - protein, 34 aa, Homo sapiens
  Payload ID: 17016
  Gene Symbol: SYNPR
  Gene Name: synaptoporin
  ENSP ID: ENSP00000402121
MDPVSQLASAGTFRVLKEPLAFLRALELVAPGDV

SEQ ID NO: 85623 - protein, 201 aa, Homo sapiens
  Payload ID: 17016
  Gene Symbol: SYNPR
  Gene Name: synaptoporin
  ENSP ID: ENSP00000418123
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 85624 - protein, 276 aa, Homo sapiens
  Payload ID: 17016
  Gene Symbol: SYNPR
  Gene Name: synaptoporin
  ENSP ID: ENSP00000418701
MCMVIFAPHNEECKSHFHLLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 85625 - protein, 202 aa, Homo sapiens
  Payload ID: 17016
  Gene Symbol: SYNPR
  Gene Name: synaptoporin
  ENSP ID: ENSP00000418929
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVLSEIQSAKALKKRERVATLTGL

SEQ ID NO: 85626 - protein, 285 aa, Homo sapiens
  Payload ID: 17016
  Gene Symbol: SYNPR
  Gene Name: synaptoporin
  Uniprot ID: Q8TBG9
  ENSP ID: ENSP00000418994
MDPVSQLASAGTFRVLKEPLAFLRALELLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 85627 - protein, 75 aa, Homo sapiens
  Payload ID: 17016
  Gene Symbol: SYNPR
  Gene Name: synaptoporin
  ENSP ID: ENSP00000419441
MDPVSQLASAGTFRVLKEPLAFLRALELLFAIFAFATCGGYSGGLRLSVDCVNKTESNLSIDIAFAYPFRTSLSL

SEQ ID NO: 85628 - protein, 55 aa, Homo sapiens
  Payload ID: 17016
  Gene Symbol: SYNPR
  Gene Name: synaptoporin
  ENSP ID: ENSP00000420383
MCMVIFAPLFAIFAFATCGGYSGGLRLSVDCVNKTESNLSIDIAFAYPFRTSLSL

SEQ ID NO: 85629 - protein, 51 aa, Homo sapiens
  Payload ID: 17016
  Gene Symbol: SYNPR
  Gene Name: synaptoporin
  ENSP ID: ENSP00000420623
MCMVIFAPKGFLKRFFSGSLQKAFCNLCICNMRWLFWRPAAECGLRQQDRK

SEQ ID NO: 85630 - protein, 158 aa, Homo sapiens
  Payload ID: 17017
  Gene Symbol: SNAP23
  Gene Name: synaptosomal-associated protein, 23kDa
  Uniprot ID: O00161
  ENSP ID: ENSP00000207062
MDNLSSEEIQQRAHQITDESLESTRRILGLAIESQDAGIKTITMLDEQKEQLNRIEEGLDQINKDMRETEKTLTELNKCCGLCVCPCNSITNDAREDEMEENLTQVGSILGNLKDMALNIGNEIDAQNPQIKRITDKADTNRDRIDIANARAKKLIDS

SEQ ID NO: 85631 - protein, 211 aa, Homo sapiens
  Payload ID: 17017
  Gene Symbol: SNAP23
  Gene Name: synaptosomal-associated protein, 23kDa
  Uniprot ID: O00161
  ENSP ID: ENSP00000249647
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 85632 - protein, 158 aa, Homo sapiens; identical to SEQ ID NO: 85630
  Payload ID: 17017
  Gene Symbol: SNAP23
  Gene Name: synaptosomal-associated protein, 23kDa
  Uniprot ID: O00161
  ENSP ID: ENSP00000380327

SEQ ID NO: 85633 - protein, 125 aa, Homo sapiens
  Payload ID: 17017
  Gene Symbol: SNAP23
  Gene Name: synaptosomal-associated protein, 23kDa
  ENSP ID: ENSP00000454214
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNG

SEQ ID NO: 85634 - protein, 97 aa, Homo sapiens
  Payload ID: 17017
  Gene Symbol: SNAP23
  Gene Name: synaptosomal-associated protein, 23kDa
  ENSP ID: ENSP00000454799
MDNLSSEEIQQRAHQITDESLESTRRILGLAIESQDAGIKTITMLDEQKEQLNRIEEGLDQINKDMRETEKTLTELNKCCGLCVCPCNRFNIRSRAQ

SEQ ID NO: 85635 - protein, 44 aa, Homo sapiens
  Payload ID: 17017
  Gene Symbol: SNAP23
  Gene Name: synaptosomal-associated protein, 23kDa
  ENSP ID: ENSP00000454842
MDNLSSEEIQQRAHQITDESLESTRRILGLAIEYWNMTGKMNSL

SEQ ID NO: 85636 - protein, 149 aa, Homo sapiens
  Payload ID: 17017
  Gene Symbol: SNAP23
  Gene Name: synaptosomal-associated protein, 23kDa
  ENSP ID: ENSP00000455102
  MOD_RES (1)..(1): Any amino acid
XQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKQADRSGNH

SEQ ID NO: 85637 - protein, 127 aa, Homo sapiens
  Payload ID: 17017
  Gene Symbol: SNAP23
  Gene Name: synaptosomal-associated protein, 23kDa
  ENSP ID: ENSP00000455339
MDNLSSEEIQQRAHQITDESLESTRRILGLAIESQDAGIKTITMLDEQKEQLNRIEEGLDQINKDMRETEKTLTELNKCCGLCVCPCNRLTPTEIVLILPMPEQRNSLTAKATAVLLYHLFTSVAPP

SEQ ID NO: 85638 - protein, 97 aa, Homo sapiens; identical to SEQ ID NO: 85634
  Payload ID: 17017
  Gene Symbol: SNAP23
  Gene Name: synaptosomal-associated protein, 23kDa
  ENSP ID: ENSP00000455472

SEQ ID NO: 85639 - protein, 97 aa, Homo sapiens; identical to SEQ ID NO: 85634
  Payload ID: 17017
  Gene Symbol: SNAP23
  Gene Name: synaptosomal-associated protein, 23kDa
  ENSP ID: ENSP00000455652

SEQ ID NO: 85640 - protein, 154 aa, Homo sapiens
  Payload ID: 17017
  Gene Symbol: SNAP23
  Gene Name: synaptosomal-associated protein, 23kDa
  ENSP ID: ENSP00000456000
  MOD_RES (1)..(1): Any amino acid
XQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKAKNFKAWTARYLH

SEQ ID NO: 85641 - protein, 109 aa, Homo sapiens
  Payload ID: 17017
  Gene Symbol: SNAP23
  Gene Name: synaptosomal-associated protein, 23kDa
  ENSP ID: ENSP00000456035
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGEN

SEQ ID NO: 85642 - protein, 90 aa, Homo sapiens
  Payload ID: 17017
  Gene Symbol: SNAP23
  Gene Name: synaptosomal-associated protein, 23kDa
  ENSP ID: ENSP00000456144
  MOD_RES (1)..(1): Any amino acid
XGIKTITMLDEQKEQLNRIEEGLDQINKDMRETEKTLTELNKCCGLCVCPCNSKQTDLGITEDALGKHAELKTILFQAKNFKAWTARYLH

SEQ ID NO: 85643 - protein, 53 aa, Homo sapiens
  Payload ID: 17017
  Gene Symbol: SNAP23
  Gene Name: synaptosomal-associated protein, 23kDa
  ENSP ID: ENSP00000457535
MDNLSSEEIQQRAHQITDESLESTRRILGLAIEVLFLLFLVCFVVLSAFPPLS

SEQ ID NO: 85644 - protein, 142 aa, Homo sapiens
  Payload ID: 17017
  Gene Symbol: SNAP23
  Gene Name: synaptosomal-associated protein, 23kDa
  ENSP ID: ENSP00000458012
MLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIK

SEQ ID NO: 85645 - protein, 44 aa, Homo sapiens; identical to SEQ ID NO: 85635
  Payload ID: 17017
  Gene Symbol: SNAP23
  Gene Name: synaptosomal-associated protein, 23kDa
  ENSP ID: ENSP00000485888

SEQ ID NO: 85646 - protein, 53 aa, Homo sapiens; identical to SEQ ID NO: 85643
  Payload ID: 17017
  Gene Symbol: SNAP23
  Gene Name: synaptosomal-associated protein, 23kDa
  ENSP ID: ENSP00000486335

SEQ ID NO: 85647 - protein, 206 aa, Homo sapiens
  Payload ID: 17018
  Gene Symbol: SNAP25
  Gene Name: synaptosomal-associated protein, 25kDa
  Uniprot ID: P60880
  ENSP ID: ENSP00000254976
MAEDADMRNELEEMQRRADQLADESLESTRRMLQLVEESKDAGIRTLVMLDEQGEQLERIEEGMDQINKDMKEAEKNLTDLGKFCGLCVCPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 85648 - protein, 206 aa, Homo sapiens
  Payload ID: 17018
  Gene Symbol: SNAP25
  Gene Name: synaptosomal-associated protein, 25kDa
  Uniprot ID: P60880
  ENSP ID: ENSP00000307341
MAEDADMRNELEEMQRRADQLADESLESTRRMLQLVEESKDAGIRTLVMLDEQGEQLDRVEEGMNHINQDMKEAEKNLKDLGKCCGLFICPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 85649 - protein, 93 aa, Homo sapiens
  Payload ID: 17018
  Gene Symbol: SNAP25
  Gene Name: synaptosomal-associated protein, 25kDa
  ENSP ID: ENSP00000400720
MAEDADMRNELEEMQRRADQLADESLESTRRMLQLVEESKDAGIRTLVMLDEQGEQLERIEEGMDQINKDMKEAEKNLTDLGKFCGLCVCPCN

SEQ ID NO: 85650 - protein, 258 aa, Homo sapiens
  Payload ID: 17019
  Gene Symbol: SNAP29
  Gene Name: synaptosomal-associated protein, 29kDa
  Uniprot ID: O95721
  ENSP ID: ENSP00000215730
MSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 85651 - protein, 160 aa, Homo sapiens
  Payload ID: 17019
  Gene Symbol: SNAP29
  Gene Name: synaptosomal-associated protein, 29kDa
  ENSP ID: ENSP00000411095
MVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTER

SEQ ID NO: 85652 - protein, 464 aa, Homo sapiens
  Payload ID: 17020
  Gene Symbol: SNAP47
  Gene Name: synaptosomal-associated protein, 47kDa
  Uniprot ID: Q5SQN1
  ENSP ID: ENSP00000314157
MRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 85653 - protein, 464 aa, Homo sapiens; identical to SEQ ID NO: 85652
  Payload ID: 17020
  Gene Symbol: SNAP47
  Gene Name: synaptosomal-associated protein, 47kDa
  Uniprot ID: Q5SQN1
  ENSP ID: ENSP00000355721

SEQ ID NO: 85654 - protein, 222 aa, Homo sapiens
  Payload ID: 17020
  Gene Symbol: SNAP47
  Gene Name: synaptosomal-associated protein, 47kDa
  Uniprot ID: Q5SQN1
  ENSP ID: ENSP00000355722
MTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 85655 - protein, 259 aa, Homo sapiens
  Payload ID: 17020
  Gene Symbol: SNAP47
  Gene Name: synaptosomal-associated protein, 47kDa
  ENSP ID: ENSP00000402730
  MOD_RES (1)..(1): Any amino acid
XFTAQAPSGRGAAVGSGTRLASLRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQGFRPMSLSTQTVLVMLCSESAGALWRQRLS

SEQ ID NO: 85656 - protein, 438 aa, Homo sapiens
  Payload ID: 17020
  Gene Symbol: SNAP47
  Gene Name: synaptosomal-associated protein, 47kDa
  ENSP ID: ENSP00000411128
  MOD_RES (1)..(1): Any amino acid
XCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQGFRPMSLSTQTVLVMLCSESAGALWRQRLS

SEQ ID NO: 85657 - protein, 222 aa, Homo sapiens
  Payload ID: 17020
  Gene Symbol: SNAP47
  Gene Name: synaptosomal-associated protein, 47kDa
  ENSP ID: ENSP00000475207
  MOD_RES (1)..(1): Any amino acid
XADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAG

SEQ ID NO: 85658 - protein, 419 aa, Homo sapiens
  Payload ID: 17020
  Gene Symbol: SNAP47
  Gene Name: synaptosomal-associated protein, 47kDa
  ENSP ID: ENSP00000483253
MSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 85659 - protein, 256 aa, Homo sapiens
  Payload ID: 17020
  Gene Symbol: SNAP47
  Gene Name: synaptosomal-associated protein, 47kDa
  ENSP ID: ENSP00000485027
LHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQELENALHLPQGPPFLVWLPSLPYP

SEQ ID NO: 85660 - protein, 902 aa, Homo sapiens
  Payload ID: 17021
  Gene Symbol: SNAP91
  Gene Name: synaptosomal-associated protein, 91kDa
  ENSP ID: ENSP00000195649
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 85661 - protein, 149 aa, Homo sapiens
  Payload ID: 17021
  Gene Symbol: SNAP91
  Gene Name: synaptosomal-associated protein, 91kDa
  ENSP ID: ENSP00000358704
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVK

SEQ ID NO: 85662 - protein, 143 aa, Homo sapiens
  Payload ID: 17021
  Gene Symbol: SNAP91
  Gene Name: synaptosomal-associated protein, 91kDa
  ENSP ID: ENSP00000358705
  MOD_RES (1)..(1): Any amino acid
XTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGGSAEAAPELDLFAMKPPETSVPVVTPTASTAPPVPATAPSPA

SEQ ID NO: 85663 - protein, 907 aa, Homo sapiens
  Payload ID: 17021
  Gene Symbol: SNAP91
  Gene Name: synaptosomal-associated protein, 91kDa
  Uniprot ID: O60641
  ENSP ID: ENSP00000358708
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 85664 - protein, 907 aa, Homo sapiens; identical to SEQ ID NO: 85663
  Payload ID: 17021
  Gene Symbol: SNAP91
  Gene Name: synaptosomal-associated protein, 91kDa
  Uniprot ID: O60641
  ENSP ID: ENSP00000400459

SEQ ID NO: 85665 - protein, 116 aa, Homo sapiens
  Payload ID: 17021
  Gene Symbol: SNAP91
  Gene Name: synaptosomal-associated protein, 91kDa
  ENSP ID: ENSP00000427959
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSH

SEQ ID NO: 85666 - protein, 600 aa, Homo sapiens
  Payload ID: 17021
  Gene Symbol: SNAP91
  Gene Name: synaptosomal-associated protein, 91kDa
  Uniprot ID: O60641
  ENSP ID: ENSP00000428026
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEAPSSLMETLEQHLNTLEGKKPGNKSGAPSPLSKSSPATTVTSPNSTPAKTIDTSPPVDLFATASAAVPVSTSKPSSDLLDLQPDFSSGGAAAAAAPAPPPPAGGATAWGGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 85667 - protein, 43 aa, Homo sapiens
  Payload ID: 17021
  Gene Symbol: SNAP91
  Gene Name: synaptosomal-associated protein, 91kDa
  ENSP ID: ENSP00000428127
MSGQTLTDRIAAAQYSVTGSAVARAVCKATTHEVMGPKKKHLD

SEQ ID NO: 85668 - protein, 907 aa, Homo sapiens; identical to SEQ ID NO: 85663
  Payload ID: 17021
  Gene Symbol: SNAP91
  Gene Name: synaptosomal-associated protein, 91kDa
  Uniprot ID: O60641
  ENSP ID: ENSP00000428215

SEQ ID NO: 85669 - protein, 877 aa, Homo sapiens
  Payload ID: 17021
  Gene Symbol: SNAP91
  Gene Name: synaptosomal-associated protein, 91kDa
  Uniprot ID: O60641
  ENSP ID: ENSP00000428511
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNKSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 85670 - protein, 58 aa, Homo sapiens
  Payload ID: 17021
  Gene Symbol: SNAP91
  Gene Name: synaptosomal-associated protein, 91kDa
  ENSP ID: ENSP00000428592
MSGQTLTDRIAAAQYSVTGSAVARAVCKATTHEVMGPKKKHLDYLQTFFQQVLPNFEI

SEQ ID NO: 85671 - protein, 152 aa, Homo sapiens
  Payload ID: 17021
  Gene Symbol: SNAP91
  Gene Name: synaptosomal-associated protein, 91kDa
  ENSP ID: ENSP00000429429
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGA

SEQ ID NO: 85672 - protein, 120 aa, Homo sapiens
  Payload ID: 17021
  Gene Symbol: SNAP91
  Gene Name: synaptosomal-associated protein, 91kDa
  ENSP ID: ENSP00000429700
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGPMV

SEQ ID NO: 85673 - protein, 902 aa, Homo sapiens; identical to SEQ ID NO: 85660
  Payload ID: 17021
  Gene Symbol: SNAP91
  Gene Name: synaptosomal-associated protein, 91kDa
  ENSP ID: ENSP00000429776

SEQ ID NO: 85674 - protein, 58 aa, Homo sapiens; identical to SEQ ID NO: 85670
  Payload ID: 17021
  Gene Symbol: SNAP91
  Gene Name: synaptosomal-associated protein, 91kDa
  ENSP ID: ENSP00000429937

SEQ ID NO: 85675 - protein, 58 aa, Homo sapiens; identical to SEQ ID NO: 85670
  Payload ID: 17021
  Gene Symbol: SNAP91
  Gene Name: synaptosomal-associated protein, 91kDa
  ENSP ID: ENSP00000429950

SEQ ID NO: 85676 - protein, 581 aa, Homo sapiens
  Payload ID: 17021
  Gene Symbol: SNAP91
  Gene Name: synaptosomal-associated protein, 91kDa
  ENSP ID: ENSP00000430071
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNKSGAPSPLSKSSPATTVTSPNSTPAKTIDTSPPVDLFATASAAVPVSTSKPSSDLLDLQPDFSSGGAAAAAAPAPPPPAGGATAWGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNL

SEQ ID NO: 85677 - protein, 222 aa, Homo sapiens
  Payload ID: 17021
  Gene Symbol: SNAP91
  Gene Name: synaptosomal-associated protein, 91kDa
  ENSP ID: ENSP00000430255
VPESSLTADLLSGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLQYL

SEQ ID NO: 85678 - protein, 150 aa, Homo sapiens
  Payload ID: 17021
  Gene Symbol: SNAP91
  Gene Name: synaptosomal-associated protein, 91kDa
  ENSP ID: ENSP00000430441
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKK

SEQ ID NO: 85679 - protein, 66 aa, Homo sapiens
  Payload ID: 17021
  Gene Symbol: SNAP91
  Gene Name: synaptosomal-associated protein, 91kDa
  ENSP ID: ENSP00000431055
MSGQTLTDRIAAAQYSVTGSAVARAVCKATTHEVMGPKKKHLDYLIQATNETNVNIPQMADTLFER

SEQ ID NO: 85680 - protein, 562 aa, Homo sapiens
  Payload ID: 17022
  Gene Symbol: SYNCRIP
  Gene Name: synaptotagmin binding, cytoplasmic RNA interacting protein
  Uniprot ID: O60506
  ENSP ID: ENSP00000347380
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGQGKGVEAGPDLLQ

SEQ ID NO: 85681 - protein, 623 aa, Homo sapiens
  Payload ID: 17022
  Gene Symbol: SYNCRIP
  Gene Name: synaptotagmin binding, cytoplasmic RNA interacting protein
  Uniprot ID: O60506
  ENSP ID: ENSP00000358635
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGVRGARGGRGGNVGGKRKADGYNQPDSKRRQTNNQNWGSQPIAQQPLQGGDHSGNYGYKSENQEFYQDTFGQQWK

SEQ ID NO: 85682 - protein, 185 aa, Homo sapiens
  Payload ID: 17022
  Gene Symbol: SYNCRIP
  Gene Name: synaptotagmin binding, cytoplasmic RNA interacting protein
  ENSP ID: ENSP00000397782
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKA

SEQ ID NO: 85683 - protein, 464 aa, Homo sapiens
  Payload ID: 17022
  Gene Symbol: SYNCRIP
  Gene Name: synaptotagmin binding, cytoplasmic RNA interacting protein
  ENSP ID: ENSP00000484577
MKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGQGKGVEAGPDLLQ

SEQ ID NO: 85684 - protein, 422 aa, Homo sapiens
  Payload ID: 17023
  Gene Symbol: SYT1
  Gene Name: synaptotagmin I
  Uniprot ID: P21579
  ENSP ID: ENSP00000261205
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQALKDDDAETGLTDGEEKEEPKEEEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKEEQEKLGDICFSLRYVPTAGKLTVVILEAKNLKKMDVGGLSDPYVKIHLMQNGKRLKKKKTTIKKNTLNPYYNESFSFEVPFEQIQKVQVVVTVLDYDKIGKNDAIGKVFVGYNSTGAELRHWSDMLANPRRPIAQWHTLQVEEEVDAMLAVKK

SEQ ID NO: 85685 - protein, 422 aa, Homo sapiens; identical to SEQ ID NO: 85684
  Payload ID: 17023
  Gene Symbol: SYT1
  Gene Name: synaptotagmin I
  Uniprot ID: P21579
  ENSP ID: ENSP00000376932

SEQ ID NO: 85686 - protein, 419 aa, Homo sapiens
  Payload ID: 17023
  Gene Symbol: SYT1
  Gene Name: synaptotagmin I
  ENSP ID: ENSP00000391056
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQDDDAETGLTDGEEKEEPKEEEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKEEQEKLGDICFSLRYVPTAGKLTVVILEAKNLKKMDVGGLSDPYVKIHLMQNGKRLKKKKTTIKKNTLNPYYNESFSFEVPFEQIQKVQVVVTVLDYDKIGKNDAIGKVFVGYNSTGAELRHWSDMLANPRRPIAQWHTLQVEEEVDAMLAVKK

SEQ ID NO: 85687 - protein, 181 aa, Homo sapiens
  Payload ID: 17023
  Gene Symbol: SYT1
  Gene Name: synaptotagmin I
  ENSP ID: ENSP00000401559
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQALKDDDAETGLTDGEEKEEPKEEEKLGKLQYSLDYDFQNNQLLVGIIQAAELPALDMGGTSDPY

SEQ ID NO: 85688 - protein, 94 aa, Homo sapiens
  Payload ID: 17023
  Gene Symbol: SYT1
  Gene Name: synaptotagmin I
  ENSP ID: ENSP00000447035
MVSESHHEALAAPPVTTVATVLPSNATEPASPGEGKEDAFSKLKEKFMNELHKIPLPPWALIAIAIVAVLLVLTCCFCICKKCLFKKKNKKKGK

SEQ ID NO: 85689 - protein, 422 aa, Homo sapiens; identical to SEQ ID NO: 85684
  Payload ID: 17023
  Gene Symbol: SYT1
  Gene Name: synaptotagmin I
  Uniprot ID: P21579
  ENSP ID: ENSP00000447575

SEQ ID NO: 85690 - protein, 72 aa, Homo sapiens
  Payload ID: 17023
  Gene Symbol: SYT1
  Gene Name: synaptotagmin I
  ENSP ID: ENSP00000447656
MVSESHHEALAAPPVTTVATVLPSNATEPASPGEGKEDAFSKLKEKFMNELHKIPLPPWALIAIAIVAVLLV

SEQ ID NO: 85691 - protein, 173 aa, Homo sapiens
  Payload ID: 17023
  Gene Symbol: SYT1
  Gene Name: synaptotagmin I
  ENSP ID: ENSP00000448861
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQDDDAETGLTDGEEKEEPKEEEKLGKLQYSLDYDFQNNQLLVGIIQAAELPALDMGG

SEQ ID NO: 85692 - protein, 58 aa, Homo sapiens
  Payload ID: 17023
  Gene Symbol: SYT1
  Gene Name: synaptotagmin I
  ENSP ID: ENSP00000448964
MVSESHHEALAAPPVTTVATVLPSNATEPASPGEGKEDAFSKLKEKFMNELHKIPLPP

SEQ ID NO: 85693 - protein, 72 aa, Homo sapiens; identical to SEQ ID NO: 85690
  Payload ID: 17023
  Gene Symbol: SYT1
  Gene Name: synaptotagmin I
  ENSP ID: ENSP00000450321

SEQ ID NO: 85694 - protein, 419 aa, Homo sapiens
  Payload ID: 17024
  Gene Symbol: SYT2
  Gene Name: synaptotagmin II
  Uniprot ID: Q8N9I0
  ENSP ID: ENSP00000356236
MRNIFKRNQEPIVAPATTTATMPIGPVDNSTESGGAGESQEDMFAKLKEKLFNEINKIPLPPWALIAIAVVAGLLLLTCCFCICKKCCCKKKKNKKEKGKGMKNAMNMKDMKGGQDDDDAETGLTEGEGEGEEEKEPENLGKLQFSLDYDFQANQLTVGVLQAAELPALDMGGTSDPYVKVFLLPDKKKKYETKVHRKTLNPAFNETFTFKVPYQELGGKTLVMAIYDFDRFSKHDIIGEVKVPMNTVDLGQPIEEWRDLQGGEKEEPEKLGDICTSLRYVPTAGKLTVCILEAKNLKKMDVGGLSDPYVKIHLMQNGKRLKKKKTTVKKKTLNPYFNESFSFEIPFEQIQKVQVVVTVLDYDKLGKNEAIGKIFVGSNATGTELRHWSDMLANPRRPIAQWHSLKPEEEVDALLGKNK

SEQ ID NO: 85695 - protein, 419 aa, Homo sapiens; identical to SEQ ID NO: 85694
  Payload ID: 17024
  Gene Symbol: SYT2
  Gene Name: synaptotagmin II
  Uniprot ID: Q8N9I0
  ENSP ID: ENSP00000356237

SEQ ID NO: 85696 - protein, 590 aa, Homo sapiens
  Payload ID: 17025
  Gene Symbol: SYT3
  Gene Name: synaptotagmin III
  Uniprot ID: Q9BQG1
  ENSP ID: ENSP00000340914
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 85697 - protein, 590 aa, Homo sapiens; identical to SEQ ID NO: 85696
  Payload ID: 17025
  Gene Symbol: SYT3
  Gene Name: synaptotagmin III
  Uniprot ID: Q9BQG1
  ENSP ID: ENSP00000438883

SEQ ID NO: 85698 - protein, 590 aa, Homo sapiens; identical to SEQ ID NO: 85696
  Payload ID: 17025
  Gene Symbol: SYT3
  Gene Name: synaptotagmin III
  Uniprot ID: Q9BQG1
  ENSP ID: ENSP00000468982

SEQ ID NO: 85699 - protein, 590 aa, Homo sapiens; identical to SEQ ID NO: 85696
  Payload ID: 17025
  Gene Symbol: SYT3
  Gene Name: synaptotagmin III
  Uniprot ID: Q9BQG1
  ENSP ID: ENSP00000469398

SEQ ID NO: 85700 - protein, 96 aa, Homo sapiens
  Payload ID: 17025
  Gene Symbol: SYT3
  Gene Name: synaptotagmin III
  ENSP ID: ENSP00000469637
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPL

SEQ ID NO: 85701 - protein, 79 aa, Homo sapiens
  Payload ID: 17025
  Gene Symbol: SYT3
  Gene Name: synaptotagmin III
  ENSP ID: ENSP00000469834
GHNEVIGVCRVGPDAADPHGREHWAEMLANPRKPVEHWHQLVEVSRGPTPTPDKHPCTLGPFIHATNALHVRESQSQAS

SEQ ID NO: 85702 - protein, 425 aa, Homo sapiens
  Payload ID: 17026
  Gene Symbol: SYT4
  Gene Name: synaptotagmin IV
  Uniprot ID: Q9H2B2
  ENSP ID: ENSP00000255224
MAPITTSREEFDEIPTVVGIFSAFGLVFTVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 85703 - protein, 407 aa, Homo sapiens
  Payload ID: 17026
  Gene Symbol: SYT4
  Gene Name: synaptotagmin IV
  Uniprot ID: Q9H2B2
  ENSP ID: ENSP00000466930
MAPITTSREEFVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 85704 - protein, 103 aa, Homo sapiens
  Payload ID: 17026
  Gene Symbol: SYT4
  Gene Name: synaptotagmin IV
  ENSP ID: ENSP00000470516
MLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVE

SEQ ID NO: 85705 - protein, 143 aa, Homo sapiens
  Payload ID: 17026
  Gene Symbol: SYT4
  Gene Name: synaptotagmin IV
  ENSP ID: ENSP00000472583
MKSPQWWGSSVHLAWSSQSLSLHGSAVRENHPMKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPK

SEQ ID NO: 85706 - protein, 491 aa, Homo sapiens
  Payload ID: 17027
  Gene Symbol: SYT9
  Gene Name: synaptotagmin IX
  Uniprot ID: Q86SS6
  ENSP ID: ENSP00000324419
MPGARDALCHQALQLLAELCARGALEHDSCQDFIYHLRDRARPRLRDPDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARHNSIRRQLNLSNPDFNIQQLQKQEQLTGIGRIKPELYKQRSLDNDDGRRSNSKACGKLNFILKYDCDLEQLIVKIHKAVNLPAKDFSGTSDPYVKIYLLPDRKTKHQTKVHRKTLNPVFDEVFLFPVPYNDLEARKLHFSVYDFDRFSRHDLIGQVVVDHFLDLADFPRECILWKDIEYVTNDNVDLGELMFSLCYLPTAGRLTITIIKARNLKAMDITGASDPYVKVSLMCDGRRLKKRKTSTKRNTLNPVYNEAIVFDVPPENIDQIHLSIAVMDYDRVGHNEIIGVCQVGNEAERLGRDHWSEMLSYPRKPIAHWHSLVEKR

SEQ ID NO: 85707 - protein, 319 aa, Homo sapiens
  Payload ID: 17027
  Gene Symbol: SYT9
  Gene Name: synaptotagmin IX
  ENSP ID: ENSP00000432141
MLAKVVEGDLAFKGGRDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARHNSIRRQLNLSNPDFNIQQLQKQEQLTGIGRIKPELYKQRSLDNDDGRRSNSKACGKLNFILKYDCDLEQLIVKIHKAVNLPAKDFSGTSDPYVKIYLLPDRKTKHQTKVHRKTLNPVFDEVFLFPVPYNDLEARKLHFSVYDFDRFSRHDLIGQVVVDHFLDLADFPRECILWKDIEYVTNILS

SEQ ID NO: 85708 - protein, 173 aa, Homo sapiens
  Payload ID: 17027
  Gene Symbol: SYT9
  Gene Name: synaptotagmin IX
  ENSP ID: ENSP00000434558
MPGARDALCHQALQLLAELCARGALEHDSCQDFIYHLRDRARPRLRDPDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARTTWIWES

SEQ ID NO: 85709 - protein, 386 aa, Homo sapiens
  Payload ID: 17028
  Gene Symbol: SYT5
  Gene Name: synaptotagmin V
  Uniprot ID: O00445
  ENSP ID: ENSP00000346265
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYVELGGRVLVMAVYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 85710 - protein, 386 aa, Homo sapiens; identical to SEQ ID NO: 85709
  Payload ID: 17028
  Gene Symbol: SYT5
  Gene Name: synaptotagmin V
  Uniprot ID: O00445
  ENSP ID: ENSP00000442896

SEQ ID NO: 85711 - protein, 49 aa, Homo sapiens
  Payload ID: 17028
  Gene Symbol: SYT5
  Gene Name: synaptotagmin V
  ENSP ID: ENSP00000465074
MFPEPPTPGPPSPDTPPDSSRISHGPGAARSRGAGASTIRARAAGGRQA

SEQ ID NO: 85712 - protein, 152 aa, Homo sapiens
  Payload ID: 17028
  Gene Symbol: SYT5
  Gene Name: synaptotagmin V
  ENSP ID: ENSP00000465110
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYL

SEQ ID NO: 85713 - protein, 67 aa, Homo sapiens
  Payload ID: 17028
  Gene Symbol: SYT5
  Gene Name: synaptotagmin V
  ENSP ID: ENSP00000465304
MDVGGLSDPYVKVHLLQGGKKVRKKKTTIKKNTLNPYYNEAFSFEVPCDQVQKVQVELTVLDYDKLG

SEQ ID NO: 85714 - protein, 382 aa, Homo sapiens
  Payload ID: 17028
  Gene Symbol: SYT5
  Gene Name: synaptotagmin V
  Uniprot ID: O00445
  ENSP ID: ENSP00000465576
MTRGGCPVSARLFAQRPHGSWSSLLCVGLKGRLGWEWGTRVLECLCRKDSRTPPPCSRSPQPRGLHRPTRLPTPVASATAQVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYVELGGRVLVMAVYDFDRFSRNDAIGEVRVPMSSVDLGRPVQAWRELQAAPREEEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 85715 - protein, 154 aa, Homo sapiens
  Payload ID: 17028
  Gene Symbol: SYT5
  Gene Name: synaptotagmin V
  ENSP ID: ENSP00000467685
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYLLP

SEQ ID NO: 85716 - protein, 22 aa, Homo sapiens
  Payload ID: 17028
  Gene Symbol: SYT5
  Gene Name: synaptotagmin V
  ENSP ID: ENSP00000469874
  MOD_RES (1)..(1): Any amino acid
XYYNEAFSFEVPCDQVQGRRLP

SEQ ID NO: 85717 - protein, 425 aa, Homo sapiens
  Payload ID: 17029
  Gene Symbol: SYT6
  Gene Name: synaptotagmin VI
  Uniprot ID: Q5T7P8
  ENSP ID: ENSP00000358560
MPWRNKEASSPSSANPPLEALQSPSFRGNMADKLKDPSTLGFLEAAVKISHTSPDIPAEVQMSVKEHIMRHTRLQRQTTEPASSTRHTSFKRHLPRQMHVSSVDYGNELPPAAEQPTSIGRIKPELYKQKSVDGEDAKSEATKSCGKINFSLRYDYETETLIVRILKAFDLPAKDFCGSSDPYVKIYLLPDRKCKLQTRVHRKTLNPTFDENFHFPVPYEELADRKLHLSVFDFDRFSRHDMIGEVILDNLFEASDLSRETSIWKDIQYATSESVDLGEIMFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGITAEGLGRDHWNEMLAYPRKPIAHWHSLVEVKKSFKEGNPRL

SEQ ID NO: 85718 - protein, 125 aa, Homo sapiens
  Payload ID: 17029
  Gene Symbol: SYT6
  Gene Name: synaptotagmin VI
  ENSP ID: ENSP00000476324
MACRALAAGAAGGSATWRPAQGTSVSLLAVVVIVCGVALVAVFLFLFWKLCWMPWRNKEASSPSSANPPLEALQSPSFRGNMADKLKDPSTLGFLEAAVKISHTSPDIPAEVQMSVKEHIMRHTR

SEQ ID NO: 85719 - protein, 510 aa, Homo sapiens
  Payload ID: 17029
  Gene Symbol: SYT6
  Gene Name: synaptotagmin VI
  Uniprot ID: Q5T7P8
  ENSP ID: ENSP00000476396
MSGVWGAGGPRCQEALAVLASLCRARPPPLGLDVETCRSFELQPPERSPSAAGAGTSVSLLAVVVIVCGVALVAVFLFLFWKLCWMPWRNKEASSPSSANPPLEALQSPSFRGNMADKLKDPSTLGFLEAAVKISHTSPDIPAEVQMSVKEHIMRHTRLQRQTTEPASSTRHTSFKRHLPRQMHVSSVDYGNELPPAAEQPTSIGRIKPELYKQKSVDGEDAKSEATKSCGKINFSLRYDYETETLIVRILKAFDLPAKDFCGSSDPYVKIYLLPDRKCKLQTRVHRKTLNPTFDENFHFPVPYEELADRKLHLSVFDFDRFSRHDMIGEVILDNLFEASDLSRETSIWKDIQYATSESVDLGEIMFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGITAEGLGRDHWNEMLAYPRKPIAHWHSLVEVKKSFKEGNPRL

SEQ ID NO: 85720 - protein, 425 aa, Homo sapiens; identical to SEQ ID NO: 85717
  Payload ID: 17029
  Gene Symbol: SYT6
  Gene Name: synaptotagmin VI
  Uniprot ID: Q5T7P8
  ENSP ID: ENSP00000476507

SEQ ID NO: 85721 - protein, 71 aa, Homo sapiens
  Payload ID: 17029
  Gene Symbol: SYT6
  Gene Name: synaptotagmin VI
  ENSP ID: ENSP00000476562
MSGVWGAGGPRCQEALAVLASLCRARPPPLGLDVETCRSFELQPPERSPSAAGAAVLDALEEQGGLQSLFC

SEQ ID NO: 85722 - protein, 214 aa, Homo sapiens
  Payload ID: 17029
  Gene Symbol: SYT6
  Gene Name: synaptotagmin VI
  ENSP ID: ENSP00000476616
MPWRNKEASSPSSANPPLEALQSPSFRGNMADKLKDPSTLGFLEAAVKISHTSPDIPAEVQMSVKEHIMRHTRLQRQTTEPASSTRHTSFKRHLPRQMHVSSVDYGNELPPAAEQPTSIGRIKPELYKQKSVDGEDAKSEATKSCGKINFSLRYDYETETLIVRILKAFDLPAKDFCGSSDPYVKIYLLPDRKCKLQTRVHRKTLNPTFDENFH

SEQ ID NO: 85723 - protein, 88 aa, Homo sapiens
  Payload ID: 17029
  Gene Symbol: SYT6
  Gene Name: synaptotagmin VI
  ENSP ID: ENSP00000477219
MPWRNKEASSPSSANPPLEALQSPSFRGNMADKLKDPSTLGFLEAAVKISHTSPDIPAEVQMSVKEHIMRHTRLQRQTTEPASSTRHT

SEQ ID NO: 85724 - protein, 71 aa, Homo sapiens; identical to SEQ ID NO: 85721
  Payload ID: 17029
  Gene Symbol: SYT6
  Gene Name: synaptotagmin VI
  ENSP ID: ENSP00000477325

SEQ ID NO: 85725 - protein, 425 aa, Homo sapiens; identical to SEQ ID NO: 85717
  Payload ID: 17029
  Gene Symbol: SYT6
  Gene Name: synaptotagmin VI
  Uniprot ID: Q5T7P8
  ENSP ID: ENSP00000477344

SEQ ID NO: 85726 - protein, 403 aa, Homo sapiens
  Payload ID: 17030
  Gene Symbol: SYT7
  Gene Name: synaptotagmin VII
  Uniprot ID: O43581
  ENSP ID: ENSP00000263846
MYRDPEAASPGAPSRDVLLVSAIITVSLSVTVVLCGLCHWCQRKLGKRYKNSLETVGTPDSGRGRSEKKAIKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 85727 - protein, 522 aa, Homo sapiens
  Payload ID: 17030
  Gene Symbol: SYT7
  Gene Name: synaptotagmin VII
  ENSP ID: ENSP00000437720
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNGTLLSGAKVAAAAGLAVEREGRLGEKPAPVPPPGEDALRSGGAAPSEPGSGGKAGRGRWRTVQSHLAAGKLNLSKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 85728 - protein, 122 aa, Homo sapiens
  Payload ID: 17030
  Gene Symbol: SYT7
  Gene Name: synaptotagmin VII
  ENSP ID: ENSP00000438171
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNPLFLRR

SEQ ID NO: 85729 - protein, 686 aa, Homo sapiens
  Payload ID: 17030
  Gene Symbol: SYT7
  Gene Name: synaptotagmin VII
  ENSP ID: ENSP00000439694
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNGTLLSGAKVAAAAGLAVEREGRLGEKPAPVPPPGEDALRSGGAAPSEPGSGGKAGRGRWRTVQSHLAAGKLNLSNFEDSTLSTATTLESIPSSTGEPKCQRPRTLMRQQSLQQPLSQHQRGRQPSQPTTSQSLGQLQAHMASAPGPNPRAYGRGQARQGTSAGSKYRAAGGRSRSNPGSWDHVVGQIRNRGLDMKSFLEGRMVVLSLVLGLSEQDDFANIPDLQNPGTQQNQNAQGDKRLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 85730 - protein, 122 aa, Homo sapiens; identical to SEQ ID NO: 85728
  Payload ID: 17030
  Gene Symbol: SYT7
  Gene Name: synaptotagmin VII
  ENSP ID: ENSP00000441184

SEQ ID NO: 85731 - protein, 175 aa, Homo sapiens
  Payload ID: 17030
  Gene Symbol: SYT7
  Gene Name: synaptotagmin VII
  ENSP ID: ENSP00000443576
MYRDPEAASPGAPSRDVLLVSAIITVSLSVTVVLCGLCHWCQRKLGKRYKNSLETVGTPDSGRGRSEKKAIKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFV

SEQ ID NO: 85732 - protein, 611 aa, Homo sapiens
  Payload ID: 17030
  Gene Symbol: SYT7
  Gene Name: synaptotagmin VII
  ENSP ID: ENSP00000444019
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNFEDSTLSTATTLESIPSSTGEPKCQRPRTLMRQQSLQQPLSQHQRGRQPSQPTTSQSLGQLQAHMASAPGPNPRAYGRGQARQGTSAGSKYRAAGGRSRSNPGSWDHVVGQIRNRGLDMKSFLEGRMVVLSLVLGLSEQDDFANIPDLQNPGTQQNQNAQGDKRLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 85733 - protein, 478 aa, Homo sapiens
  Payload ID: 17030
  Gene Symbol: SYT7
  Gene Name: synaptotagmin VII
  Uniprot ID: O43581
  ENSP ID: ENSP00000444201
MYRDPEAASPGAPSRDVLLVSAIITVSLSVTVVLCGLCHWCQRKLGKRYKNSLETVGTPDSGRGRSEKKAINGTLLSGAKVAAAAGLAVEREGRLGEKPAPVPPPGEDALRSGGAAPSEPGSGGKAGRGRWRTVQSHLAAGKLNLSKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 85734 - protein, 447 aa, Homo sapiens
  Payload ID: 17030
  Gene Symbol: SYT7
  Gene Name: synaptotagmin VII
  ENSP ID: ENSP00000444568
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 85735 - protein, 387 aa, Homo sapiens
  Payload ID: 17031
  Gene Symbol: SYT8
  Gene Name: synaptotagmin VIII
  ENSP ID: ENSP00000343691
MGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGCLQLSLEFDFGSQEIRVGLRQAADLRPGGTVDPYARVSVSTQAGHRHETKVHRGTLCPVFDETCCFHIPQAELPGATLQVQLFNFKRFSGHEPLGELRLPLGTVDLQHVLEHWYLLGPPAATQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 85736 - protein, 401 aa, Homo sapiens
  Payload ID: 17031
  Gene Symbol: SYT8
  Gene Name: synaptotagmin VIII
  Uniprot ID: Q8NBV8
  ENSP ID: ENSP00000371394
MLHLHGWQTMQGRKMGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGCLQLSLEFDFGSQEIRVGLRQAADLRPGGTVDPYARVSVSTQAGHRHETKVHRGTLCPVFDETCCFHIPQAELPGATLQVQLFNFKRFSGHEPLGELRLPLGTVDLQHVLEHWYLLGPPAATQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 85737 - protein, 400 aa, Homo sapiens
  Payload ID: 17031
  Gene Symbol: SYT8
  Gene Name: synaptotagmin VIII
  ENSP ID: ENSP00000371406
  MOD_RES (1)..(1): Any amino acid
XGKPWWAPAVGRKMGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGCLQLSLEFDFGSQEIRVGLRQAADLRPGGTVDPYARVSVSTQAGHRHETKVHRGTLCPVFDETCCFHIPQAELPGATLQVQLFNFKRFSGHEPLGELRLPLGTVDLQHVLEHWYLLGPPAATQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 85738 - protein, 99 aa, Homo sapiens
  Payload ID: 17031
  Gene Symbol: SYT8
  Gene Name: synaptotagmin VIII
  ENSP ID: ENSP00000387678
MGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPG

SEQ ID NO: 85739 - protein, 102 aa, Homo sapiens
  Payload ID: 17031
  Gene Symbol: SYT8
  Gene Name: synaptotagmin VIII
  ENSP ID: ENSP00000392469
MGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQ

SEQ ID NO: 85740 - protein, 129 aa, Homo sapiens
  Payload ID: 17031
  Gene Symbol: SYT8
  Gene Name: synaptotagmin VIII
  ENSP ID: ENSP00000405850
MGHPPVSPSAPAPAGTTAIPGLIPDLVAGTPSWPLPQGPAGLSLPAPLPRASSSSPASSVLPAAAAAATGRSPGTRSPWVWAVPAAPPPPTWCNLMWMAWSPARGMLSNGGACSSPWSSTLEARRSGWA

SEQ ID NO: 85741 - protein, 523 aa, Homo sapiens
  Payload ID: 17032
  Gene Symbol: SYT10
  Gene Name: synaptotagmin X
  Uniprot ID: Q6XYQ8
  ENSP ID: ENSP00000228567
MSFHKEDGVNSLCQKALHIVTELCFAGQVEWEKCSGIFPRDRGSQGGSSTDISVSLLAVVVSFCGLALLVVSLFVFWKLCWPCWKSKPVTSNITTLPQSISSAPTEVFETEEKKEIKENEKPAVKAIEPAIKISHTSPDIPAEVQTALKEHLIKHARVQRQITEPTSSTRHSSFRRHLPRQMQVSSVDFSMGTEPVLQRGETTTSIGRIKPELYKQKSVDSEGNQNEDVKICGKLNFTLQYDYENELLVVKIIKALDLPAKDFTGTSDPYVKMYLLPDRKKKFQTRVHRKTLNPLFDETFQFPVAYDQLSNRKLHFSVYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLSIAVMDYDRVGHNEVIGVCRTGLDAEGLGRDHWNEMLAYHRKPITHWHPLLELPGRATSFDSQGSCPSPKPPSTP

SEQ ID NO: 85742 - protein, 194 aa, Homo sapiens
  Payload ID: 17032
  Gene Symbol: SYT10
  Gene Name: synaptotagmin X
  ENSP ID: ENSP00000444577
MSFHKEDGVNSLCQKALHIVTELCFAGQVEWEKCSGIFPRDRGSQGGSSTDISVSLLAVVVSFCGLALLVVSLFVFWKLCWPCWKSKPVTSNITTLPQSISSAPTEVFETEEKKEIKENEKPAVKAIEPAIKISHTSPDIPAEVQTALKEHLIKHARVQRQITEPTSSTRGWGKKKKKRILSTCNFVTMPRHPS

SEQ ID NO: 85743 - protein, 431 aa, Homo sapiens
  Payload ID: 17033
  Gene Symbol: SYT11
  Gene Name: synaptotagmin XI
  Uniprot ID: Q9BT88
  ENSP ID: ENSP00000357307
MAEITNIRPSFDVSPVVAGLIGASVLVVCVSVTVFVWSCCHQQAEKKQKNPPYKFIHMLKGISIYPETLSNKKKIIKVRRDKDGPGREGGRRNLLVDAAEAGLLSRDKDPRGPSSGSCIDQLPIKMDYGEELRSPITSLTPGESKTTSPSSPEEDVMLGSLTFSVDYNFPKKALVVTIQEAHGLPVMDDQTQGSDPYIKMTILPDKRHRVKTRVLRKTLDPVFDETFTFYGIPYSQLQDLVLHFLVLSFDRFSRDDVIGEVMVPLAGVDPSTGKVQLTRDIIKRNIQKCISRGELQVSLSYQPVAQRMTVVVLKARHLPKMDITGLSGNPYVKVNVYYGRKRIAKKKTHVKKCTLNPIFNESFIYDIPTDLLPDISIEFLVIDFDRTTKNEVVGRLILGAHSVTASGAEHWREVCESPRKPVAKWHSLSEY

SEQ ID NO: 85744 - protein, 421 aa, Homo sapiens
  Payload ID: 17034
  Gene Symbol: SYT12
  Gene Name: synaptotagmin XII
  Uniprot ID: Q8IV01
  ENSP ID: ENSP00000377520
MAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSLSIEDTFESISELGPLELMGRELDLAPYGTLRKSQSADSLNSISSVSNTFGQDFTLGQVEVSMEYDTASHTLNVAVMQGKDLLEREEASFESCFMRVSLLPDEQIVGISRIQRNAYSIFFDEKFSIPLDPTALEEKSLRFSVFGIDEDERNVSTGVVELKLSVLDLPLQPFSGWLYLQDQNKAADAVGEILLSLSYLPTAERLTVVVVKAKNLIWTNDKTTADPFVKVYLLQDGRKMSKKKTAVKRDDPNPVFNEAMIFSVPAIVLQDLSLRVTVAESSSDGRGDNVGHVIIGPSASGMGTTHWNQMLATLRRPVSMWHAVRRN

SEQ ID NO: 85745 - protein, 421 aa, Homo sapiens; identical to SEQ ID NO: 85744
  Payload ID: 17034
  Gene Symbol: SYT12
  Gene Name: synaptotagmin XII
  Uniprot ID: Q8IV01
  ENSP ID: ENSP00000431400

SEQ ID NO: 85746 - protein, 98 aa, Homo sapiens
  Payload ID: 17034
  Gene Symbol: SYT12
  Gene Name: synaptotagmin XII
  ENSP ID: ENSP00000434709
MAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSL

SEQ ID NO: 85747 - protein, 421 aa, Homo sapiens; identical to SEQ ID NO: 85744
  Payload ID: 17034
  Gene Symbol: SYT12
  Gene Name: synaptotagmin XII
  Uniprot ID: Q8IV01
  ENSP ID: ENSP00000435316

SEQ ID NO: 85748 - protein, 426 aa, Homo sapiens
  Payload ID: 17035
  Gene Symbol: SYT13
  Gene Name: synaptotagmin XIII
  Uniprot ID: Q7L8C5
  ENSP ID: ENSP00000020926
MVLSVPVIALGATLGTATSILALCGVTCLCRHMHPKKGLLPRDQDPDLEKAKPSLLGSAQQFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEAVTSNHDGGCDCYVQGSVANRTGSVEAQTALKKRQLHTTWEEGLVLPLAEEELPTATLTLTLRTCDRFSRHSVAGELRLGLDGTSVPLGAAQWGELKTSAKEPSAGAGEVLLSISYLPAANRLLVVLIKAKNLHSNQSKELLGKDVSVKVTLKHQARKLKKKQTKRAKHKINPVWNEMIMFELPDDLLQASSVELEVLGQDDSGQSCALGHCSLGLHTSGSERSHWEEMLKNPRRQIAMWHQLHL

SEQ ID NO: 85749 - protein, 186 aa, Homo sapiens
  Payload ID: 17035
  Gene Symbol: SYT13
  Gene Name: synaptotagmin XIII
  ENSP ID: ENSP00000432975
  MOD_RES (1)..(1): Any amino acid
XQSLAGRGQQTRWRTGQGVKKFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEAVTSNHDGGCDCYVQGSVANRTGSVEAQTALKKRQLHTTWEEGLV

SEQ ID NO: 85750 - protein, 20 aa, Homo sapiens
  Payload ID: 17035
  Gene Symbol: SYT13
  Gene Name: synaptotagmin XIII
  ENSP ID: ENSP00000434967
  MOD_RES (1)..(1): Any amino acid
XLEKAKPSLLGSAQQSICYI

SEQ ID NO: 85751 - protein, 517 aa, Homo sapiens
  Payload ID: 17036
  Gene Symbol: SYT14
  Gene Name: synaptotagmin XIV
  Uniprot ID: Q8NB59
  ENSP ID: ENSP00000355982
MLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 85752 - protein, 574 aa, Homo sapiens
  Payload ID: 17036
  Gene Symbol: SYT14
  Gene Name: synaptotagmin XIV
  Uniprot ID: Q8NB59
  ENSP ID: ENSP00000355986
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 85753 - protein, 555 aa, Homo sapiens
  Payload ID: 17036
  Gene Symbol: SYT14
  Gene Name: synaptotagmin XIV
  Uniprot ID: Q8NB59
  ENSP ID: ENSP00000418901
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 85754 - protein, 517 aa, Homo sapiens; identical to SEQ ID NO: 85751
  Payload ID: 17036
  Gene Symbol: SYT14
  Gene Name: synaptotagmin XIV
  Uniprot ID: Q8NB59
  ENSP ID: ENSP00000437423

SEQ ID NO: 85755 - protein, 504 aa, Homo sapiens
  Payload ID: 17036
  Gene Symbol: SYT14
  Gene Name: synaptotagmin XIV
  ENSP ID: ENSP00000442891
  MOD_RES (1)..(1): Any amino acid
XYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPTFHPLLSDGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 85756 - protein, 265 aa, Homo sapiens
  Payload ID: 17036
  Gene Symbol: SYT14
  Gene Name: synaptotagmin XIV
  Uniprot ID: Q8NB59
  ENSP ID: ENSP00000445837
MLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWAVTPK

SEQ ID NO: 85757 - protein, 619 aa, Homo sapiens
  Payload ID: 17036
  Gene Symbol: SYT14
  Gene Name: synaptotagmin XIV
  Uniprot ID: Q8NB59
  ENSP ID: ENSP00000486230
MASASWRLKVEREPVEYMNLSVLEKIGYFSVARLEYSGTILAHCNFRLLGSNDSSASASQVTGTTVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 85758 - protein, 421 aa, Homo sapiens
  Payload ID: 17037
  Gene Symbol: SYT15
  Gene Name: synaptotagmin XV
  Uniprot ID: Q9BQS2
  ENSP ID: ENSP00000363441
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 85759 - protein, 474 aa, Homo sapiens
  Payload ID: 17037
  Gene Symbol: SYT15
  Gene Name: synaptotagmin XV
  ENSP ID: ENSP00000363443
MGVVLSPHPAPSRREPLAPLAPGTRPGWSPAVSGSSRSALRPSTAGPGPGPGTGWGGTAASGRWVPAPAVHCAAPRAAAGHQQHHGPPLCSPDGAPRRFKRRPGSPAPAAQTGETSLREQPHGGPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 85760 - protein, 180 aa, Homo sapiens
  Payload ID: 17037
  Gene Symbol: SYT15
  Gene Name: synaptotagmin XV
  ENSP ID: ENSP00000363448
DEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKQATTVELFLFHLTSG

SEQ ID NO: 85761 - protein, 136 aa, Homo sapiens
  Payload ID: 17037
  Gene Symbol: SYT15
  Gene Name: synaptotagmin XV
  ENSP ID: ENSP00000424803
MAGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLK

SEQ ID NO: 85762 - protein, 390 aa, Homo sapiens
  Payload ID: 17037
  Gene Symbol: SYT15
  Gene Name: synaptotagmin XV
  Uniprot ID: Q9BQS2
  ENSP ID: ENSP00000427607
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKQATTVELFLFHLTSG

SEQ ID NO: 85763 - protein, 203 aa, Homo sapiens
  Payload ID: 17038
  Gene Symbol: SYT16
  Gene Name: synaptotagmin XVI
  Uniprot ID: Q17RD7
  ENSP ID: ENSP00000394700
MTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 85764 - protein, 383 aa, Homo sapiens
  Payload ID: 17038
  Gene Symbol: SYT16
  Gene Name: synaptotagmin XVI
  Uniprot ID: Q17RD7
  ENSP ID: ENSP00000451035
MVLAMASQDVQNFFQPFSSWISRVYEALQQAGDMLSASLVNISKQDSKLSDKLDQDLDNIQIQETYFEDEEQDNDWSQEDANSLFLEVDHFSCCNSDLQDSAQNSSPSLSQHAKDSCSTMSQWPNWASDDRKLPHVLSSIAEEEHHLEKQRSGLQHGFDSQLPGTLETVNGKKQVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPEANLNLKRKGYLLDVYCLSSPLLFTTSLHRRNRTGPICRCHPGSQSPSQSVVT

SEQ ID NO: 85765 - protein, 645 aa, Homo sapiens
  Payload ID: 17038
  Gene Symbol: SYT16
  Gene Name: synaptotagmin XVI
  Uniprot ID: Q17RD7
  ENSP ID: ENSP00000478637
MVLAMASQDVQNFFQPFSSWISRVYEALQQAGDMLSASLVNISKQDSKLSDKLDQDLDNIQIQETYFEDEEQDNDWSQEDANSLFLEVDHFSCCNSDLQDSAQNSSPSLSQHAKDSCSTMSQWPNWASDDRKLPHVLSSIAEEEHHLEKQRSGLQHGFDSQLPGTLETVNGKKQVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPEEQDRTNLQVPSGVSEPISKCGDLDVIFEYRAASQKLTVTIVRAQGLPDKDRSGVNSWQVHVVLLPGKKHRGRTNIQRGPNPVFREKVTFAKLEPRDVAACAVRFRLYAARKMTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 85766 - protein, 474 aa, Homo sapiens
  Payload ID: 17039
  Gene Symbol: SYT17
  Gene Name: synaptotagmin XVII
  Uniprot ID: Q9BSW7
  ENSP ID: ENSP00000347538
MAYIQLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 85767 - protein, 93 aa, Homo sapiens
  Payload ID: 17039
  Gene Symbol: SYT17
  Gene Name: synaptotagmin XVII
  ENSP ID: ENSP00000454335
MASRSSDKDGDSVHTASEVPLTPRTNSPDGRRSSSDTSKSTYSLTRRISSLESRRPSSPLIDIKPIEFGVLSAKKEPIQPSVLRRTYNPDDYF

SEQ ID NO: 85768 - protein, 470 aa, Homo sapiens
  Payload ID: 17039
  Gene Symbol: SYT17
  Gene Name: synaptotagmin XVII
  ENSP ID: ENSP00000454721
MLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 85769 - protein, 392 aa, Homo sapiens
  Payload ID: 17039
  Gene Symbol: SYT17
  Gene Name: synaptotagmin XVII
  ENSP ID: ENSP00000456009
MASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTGSNSPIPACELSSHPAHGISPWIPSPGNEHFHGIKKQVKAIKVE

SEQ ID NO: 85770 - protein, 413 aa, Homo sapiens
  Payload ID: 17039
  Gene Symbol: SYT17
  Gene Name: synaptotagmin XVII
  ENSP ID: ENSP00000456252
MASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 85771 - protein, 79 aa, Homo sapiens
  Payload ID: 17039
  Gene Symbol: SYT17
  Gene Name: synaptotagmin XVII
  ENSP ID: ENSP00000456790
MASRSSDKDGDSVHTASEVPLTPRTNSPDGRRSSSDTSKSTYSLTRRISSLESRRPSSPLIDIKPIEFGVLSAKKEPIQ

SEQ ID NO: 85772 - protein, 142 aa, Homo sapiens
  Payload ID: 17039
  Gene Symbol: SYT17
  Gene Name: synaptotagmin XVII
  ENSP ID: ENSP00000456879
  MOD_RES (1)..(1): Any amino acid
XPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSAGAWTQTCENQEDVLLKGHN

SEQ ID NO: 85773 - protein, 168 aa, Homo sapiens
  Payload ID: 17039
  Gene Symbol: SYT17
  Gene Name: synaptotagmin XVII
  ENSP ID: ENSP00000456915
MGTFFAFMEKKNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 85774 - protein, 444 aa, Homo sapiens
  Payload ID: 17040
  Gene Symbol:
  Gene Name: Synaptotagmin-15
  ENSP ID: ENSP00000478933
  MOD_RES (1)..(1): Any amino acid
XRDGLAAQPQPPRPARPACGSSPMAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 85775 - protein, 390 aa, Homo sapiens; identical to SEQ ID NO: 85762
  Payload ID: 17040
  Gene Symbol:
  Gene Name: Synaptotagmin-15
  ENSP ID: ENSP00000482225

SEQ ID NO: 85776 - protein, 474 aa, Homo sapiens; identical to SEQ ID NO: 85759
  Payload ID: 17040
  Gene Symbol:
  Gene Name: Synaptotagmin-15
  ENSP ID: ENSP00000485217

SEQ ID NO: 85777 - protein, 550 aa, Homo sapiens
  Payload ID: 17041
  Gene Symbol: SYTL1
  Gene Name: synaptotagmin-like 1
  Uniprot ID: Q8IYJ3
  ENSP ID: ENSP00000316464
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSQASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 85778 - protein, 76 aa, Homo sapiens
  Payload ID: 17041
  Gene Symbol: SYTL1
  Gene Name: synaptotagmin-like 1
  ENSP ID: ENSP00000420110
MPQRGHPSQEGLWALPSLPMAHGPKPETEGLLDLSFLTEEEQEAIAGVLQRDARLRQLEEGRVSKLRASVADPGQL

SEQ ID NO: 85779 - protein, 562 aa, Homo sapiens
  Payload ID: 17041
  Gene Symbol: SYTL1
  Gene Name: synaptotagmin-like 1
  Uniprot ID: Q8IYJ3
  ENSP ID: ENSP00000440704
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSQASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 85780 - protein, 562 aa, Homo sapiens; identical to SEQ ID NO: 85779
  Payload ID: 17041
  Gene Symbol: SYTL1
  Gene Name: synaptotagmin-like 1
  Uniprot ID: Q8IYJ3
  ENSP ID: ENSP00000481032

SEQ ID NO: 85781 - protein, 497 aa, Homo sapiens
  Payload ID: 17041
  Gene Symbol: SYTL1
  Gene Name: synaptotagmin-like 1
  ENSP ID: ENSP00000484337
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRVPPSPDDLPSRGLLALSLKYVPAGSEGAGLPPSGELHFWVKEARDLLPLRAGSLDTYVQCFVLPDDSQASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 85782 - protein, 935 aa, Homo sapiens
  Payload ID: 17042
  Gene Symbol: SYTL2
  Gene Name: synaptotagmin-like 2
  Uniprot ID: Q9HCH5
  ENSP ID: ENSP00000318803
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKQRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85783 - protein, 935 aa, Homo sapiens; identical to SEQ ID NO: 85782
  Payload ID: 17042
  Gene Symbol: SYTL2
  Gene Name: synaptotagmin-like 2
  Uniprot ID: Q9HCH5
  ENSP ID: ENSP00000352065

SEQ ID NO: 85784 - protein, 365 aa, Homo sapiens
  Payload ID: 17042
  Gene Symbol: SYTL2
  Gene Name: synaptotagmin-like 2
  Uniprot ID: Q9HCH5
  ENSP ID: ENSP00000374608
MSDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85785 - protein, 910 aa, Homo sapiens
  Payload ID: 17042
  Gene Symbol: SYTL2
  Gene Name: synaptotagmin-like 2
  Uniprot ID: Q9HCH5
  ENSP ID: ENSP00000374610
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85786 - protein, 934 aa, Homo sapiens
  Payload ID: 17042
  Gene Symbol: SYTL2
  Gene Name: synaptotagmin-like 2
  Uniprot ID: Q9HCH5
  ENSP ID: ENSP00000431701
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85787 - protein, 69 aa, Homo sapiens
  Payload ID: 17042
  Gene Symbol: SYTL2
  Gene Name: synaptotagmin-like 2
  ENSP ID: ENSP00000431703
MSKSVPAFLQDESDDRETDTASESSYQLSRHKKSPSSLTNLSSSSGMTSLSSVSGSVMSVYSGDFGNLE

SEQ ID NO: 85788 - protein, 63 aa, Homo sapiens
  Payload ID: 17042
  Gene Symbol: SYTL2
  Gene Name: synaptotagmin-like 2
  ENSP ID: ENSP00000432116
MSKSVPAFLQDESDDRETDTASESSYQLSRHKKSPSSLTNLSSSSGMTSLSSVSGSVMSVYSG

SEQ ID NO: 85789 - protein, 155 aa, Homo sapiens
  Payload ID: 17042
  Gene Symbol: SYTL2
  Gene Name: synaptotagmin-like 2
  ENSP ID: ENSP00000432137
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQK

SEQ ID NO: 85790 - protein, 336 aa, Homo sapiens
  Payload ID: 17042
  Gene Symbol: SYTL2
  Gene Name: synaptotagmin-like 2
  Uniprot ID: Q9HCH5
  ENSP ID: ENSP00000432144
MSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85791 - protein, 376 aa, Homo sapiens
  Payload ID: 17042
  Gene Symbol: SYTL2
  Gene Name: synaptotagmin-like 2
  Uniprot ID: Q9HCH5
  ENSP ID: ENSP00000432996
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85792 - protein, 902 aa, Homo sapiens
  Payload ID: 17042
  Gene Symbol: SYTL2
  Gene Name: synaptotagmin-like 2
  Uniprot ID: Q9HCH5
  ENSP ID: ENSP00000434010
MSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85793 - protein, 103 aa, Homo sapiens
  Payload ID: 17042
  Gene Symbol: SYTL2
  Gene Name: synaptotagmin-like 2
  ENSP ID: ENSP00000434111
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVK

SEQ ID NO: 85794 - protein, 7 aa, Homo sapiens
  Payload ID: 17042
  Gene Symbol: SYTL2
  Gene Name: synaptotagmin-like 2
  ENSP ID: ENSP00000434621
MSKSVPA

SEQ ID NO: 85795 - protein, 910 aa, Homo sapiens; identical to SEQ ID NO: 85785
  Payload ID: 17042
  Gene Symbol: SYTL2
  Gene Name: synaptotagmin-like 2
  Uniprot ID: Q9HCH5
  ENSP ID: ENSP00000435238

SEQ ID NO: 85796 - protein, 376 aa, Homo sapiens; identical to SEQ ID NO: 85791
  Payload ID: 17042
  Gene Symbol: SYTL2
  Gene Name: synaptotagmin-like 2
  Uniprot ID: Q9HCH5
  ENSP ID: ENSP00000435855

SEQ ID NO: 85797 - protein, 124 aa, Homo sapiens
  Payload ID: 17042
  Gene Symbol: SYTL2
  Gene Name: synaptotagmin-like 2
  ENSP ID: ENSP00000436164
MRTKKMSKSVPAFLQDECKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRK

SEQ ID NO: 85798 - protein, 100 aa, Homo sapiens
  Payload ID: 17042
  Gene Symbol: SYTL2
  Gene Name: synaptotagmin-like 2
  ENSP ID: ENSP00000436678
MSKSVPAFLQDEVSGSVMSVYSGDFGNLEVKGNIQFAIEYVESLKELHVFVAQCKDLAAADVKKQRSDPWSFTVVAQAGTISAHSNLRLPGSSDSPASAS

SEQ ID NO: 85799 - protein, 160 aa, Homo sapiens
  Payload ID: 17042
  Gene Symbol: SYTL2
  Gene Name: synaptotagmin-like 2
  ENSP ID: ENSP00000437005
MSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRK

SEQ ID NO: 85800 - protein, 651 aa, Homo sapiens
  Payload ID: 17042
  Gene Symbol: SYTL2
  Gene Name: synaptotagmin-like 2
  ENSP ID: ENSP00000488994
ETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85801 - protein, 1276 aa, Homo sapiens
  Payload ID: 17042
  Gene Symbol: SYTL2
  Gene Name: synaptotagmin-like 2
  ENSP ID: ENSP00000489095
LKERMDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85802 - protein, 2223 aa, Homo sapiens
  Payload ID: 17042
  Gene Symbol: SYTL2
  Gene Name: synaptotagmin-like 2
  ENSP ID: ENSP00000489269
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKQRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGKPPPLPALKAKTSSRSGPYATEIKKSTDDSIFKVLDWFNRSSYSDDNKSFLQHPRGIESKEKTDSKSQVAVDLVTDDTTLRENGSKTLSPSKIELKPVRSDSPFQAEGDMLVSESCQDNNVNIKSKFMNLSQKGTPKEGPGILQPFESYGTPSQGSKNMDYSQDSKSPGKGNGASPSNSNYSYSVLKESDAENQVPCNTNNIGNLGEEEPKFHAHEENRGHSEVNFDSSTVVKEPGLKDNMNAERKSKVGNTYILKASLEPENIKSTPGVANNGSPWKKPEVQFQQEAGEVPKNQVQREKYKRVSDRISFWEGEKAGAKITHEKPTSSCSQEQPSAKAYQPVKKSQGVSSMDSLSTDQSEYNQAIPKRVVLDEDDQASQLSNSYSSNKSKETKPQIAGPSRYYLSAEQSDKVSLFQNKKNEPIKRSQVADSLPSRRNITLPALQPPSNVGSERHAPLEKDRPLVRESNANFKVMSLKERMDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 85803 - protein, 866 aa, Homo sapiens
  Payload ID: 17042
  Gene Symbol: SYTL2
  Gene Name: synaptotagmin-like 2
  ENSP ID: ENSP00000489554
LKERMDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDDF

SEQ ID NO: 85804 - protein, 610 aa, Homo sapiens
  Payload ID: 17043
  Gene Symbol: SYTL3
  Gene Name: synaptotagmin-like 3
  Uniprot ID: Q4VX76
  ENSP ID: ENSP00000297239
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRNVKIKTGEWFYEERAKKFPTGGKHETVGGQLLQSYQKLSKISVVPPTPPPVSESQCSRSPGRLQEFGQFRGFNKSVENLFLSLATHVKKLSKSQNDMTSEKHLLATGPRQCVGQTERRSQSDTAVNVTTRKVSAPDILKPLNQEDPKCSTNPILKQQNLPSSPAPSTIFSGGFRHGSLISIDSTCTEMGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIIPLATWDFEDSTTQSFRWHPLRAKAEKYEDSVPQSNGELTVRAKLVLPSRPRKLQEAQEGTDQPSLHGQLCLVVLGAKNLPVRPDGTLNSFVKGCLTLPDQQKLRLKSPVLRKQACPQWKHSFVFSGVTPAQLRQSSLELTVWDQALFGMNDRLLGGTRLGSKGDTAVGGDACSLSKLQWQKVLSSPNLWTDMTLVLH

SEQ ID NO: 85805 - protein, 610 aa, Homo sapiens; identical to SEQ ID NO: 85804
  Payload ID: 17043
  Gene Symbol: SYTL3
  Gene Name: synaptotagmin-like 3
  Uniprot ID: Q4VX76
  ENSP ID: ENSP00000353631

SEQ ID NO: 85806 - protein, 542 aa, Homo sapiens
  Payload ID: 17043
  Gene Symbol: SYTL3
  Gene Name: synaptotagmin-like 3
  Uniprot ID: Q4VX76
  ENSP ID: ENSP00000356048
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRNVKIKTGEWFYEERAKKFPTGGKHETVGGQLLQSYQKLSKISVVPPTPPPVSESQCSRSPGRKVSAPDILKPLNQEDPKCSTNPILKQQNLPSSPAPSTIFSGGFRHGSLISIDSTCTEMGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIIPLATWDFEDSTTQSFRWHPLRAKAEKYEDSVPQSNGELTVRAKLVLPSRPRKLQEAQEGTDQPSLHGQLCLVVLGAKNLPVRPDGTLNSFVKGCLTLPDQQKLRLKSPVLRKQACPQWKHSFVFSGVTPAQLRQSSLELTVWDQALFGMNDRLLGGTRLGSKGDTAVGGDACSLSKLQWQKVLSSPNLWTDMTLVLH

SEQ ID NO: 85807 - protein, 610 aa, Homo sapiens; identical to SEQ ID NO: 85804
  Payload ID: 17043
  Gene Symbol: SYTL3
  Gene Name: synaptotagmin-like 3
  Uniprot ID: Q4VX76
  ENSP ID: ENSP00000483936

SEQ ID NO: 85808 - protein, 671 aa, Homo sapiens
  Payload ID: 17044
  Gene Symbol: SYTL4
  Gene Name: synaptotagmin-like 4
  Uniprot ID: Q96C24
  ENSP ID: ENSP00000263033
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMSTIGSMMSIYSEAGDFGNIFVTGRIAFSLKYEQQTQSLVVHVKECHQLAYADEAKKRSNPYVKTYLLPDKSRQGKRKTSIKRDTINPLYDETLRYEIPESLLAQRTLQFSVWHHGRFGRNTFLGEAEIQMDSWKLDKKLDHCLPLHGKISAESPTGLPSHKGELVVSLKYIPASKTPVGGDRKKSKGGEGGELQVWIKEAKNLTAAKAGGTSDSFVKGYLLPMRNKASKRKTPVMKKTLNPHYNHTFVYNGVRLEDLQHMCLELTVWDREPLASNDFLGGVRLGVGTGISNGEVVDWMDSTGEEVSLWQKMRQYPGSWAEGTLQLRSSMAKQKLGL

SEQ ID NO: 85809 - protein, 671 aa, Homo sapiens; identical to SEQ ID NO: 85808
  Payload ID: 17044
  Gene Symbol: SYTL4
  Gene Name: synaptotagmin-like 4
  Uniprot ID: Q96C24
  ENSP ID: ENSP00000276141

SEQ ID NO: 85810 - protein, 349 aa, Homo sapiens
  Payload ID: 17044
  Gene Symbol: SYTL4
  Gene Name: synaptotagmin-like 4
  Uniprot ID: Q96C24
  ENSP ID: ENSP00000362072
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMVSSIRSVVTGMLGY

SEQ ID NO: 85811 - protein, 671 aa, Homo sapiens; identical to SEQ ID NO: 85808
  Payload ID: 17044
  Gene Symbol: SYTL4
  Gene Name: synaptotagmin-like 4
  Uniprot ID: Q96C24
  ENSP ID: ENSP00000362080

SEQ ID NO: 85812 - protein, 730 aa, Homo sapiens
  Payload ID: 17045
  Gene Symbol: SYTL5
  Gene Name: synaptotagmin-like 5
  Uniprot ID: Q8TDW5
  ENSP ID: ENSP00000297875
MSKNSEFINLSFLLDHEKEMILGVLKRDEYLKKVEDKRIRKLKNELLEAKRRSGKTQQEASRVCVHCHRNLGLIFDRGDPCQACSLRVCRECRVAGPNGSWKCTVCDKIAQLRIITGEWFFEEKAKRFKQVNVLGTDVVRQSILRRSPGAEEVQSQEQTRQDAEKSDTSPVAGKKASHDGPKRKGFLLSKFRSATRGEIITPKTDTGRSYSLDLDGQHFRSLKSPPGSDRGSTGSSDLNDQEPGPRTPKSSRSNGVTPGTQSSPAPSTRTVTSVISREYGFENSMDLAAIEGTSQELTKSHRRNTSGTPSIAVSGTSLSSDQSRSELDLSESFTEDSEDTVSIRSKSVPGALDKDSLEETEESIDALVSSQLSTNTHRLASGLSTTSLNSMMSVYSETGDYGNVKVSGEILLHISYCYKTGGLYIFVKNCRNLAIGDEKKQRTDAYVKSYLLPDKSRNNKRKTKIRTGTNPEFNETLKYTISHTQLETRTLQLSVWHYDRFGRNSFLGEVEIPFDSWNFENPTDEWFVLQPKVEFAPDIGLQYKGELTVVLRYIPPEENLMLPPEQLQGNKTFKKGKKKESPVISGGILEVFIKEAKNLTAVKSGGTSDSFVKGYLLPDDSKATKHKTLVIKKSVNPQWNHTFMFSGIHPQDIKNVCLELTIWDKEAFSSNIFLGGVRLNSGSGVSHGKNVDWMDSQGEEQRLWQKMANNPGTPFEGVLMLRSSMGKCRL

SEQ ID NO: 85813 - protein, 752 aa, Homo sapiens
  Payload ID: 17045
  Gene Symbol: SYTL5
  Gene Name: synaptotagmin-like 5
  Uniprot ID: Q8TDW5
  ENSP ID: ENSP00000395220
MSKNSEFINLSFLLDHEKEMILGVLKRDEYLKKVEDKRIRKLKNELLEAKRRSGKTQQEASRVCVHCHRNLGLIFDRGDPCQACSLRVCRECRVAGPNGSWKCTVCDKIAQLRIITGEWFFEEKAKRFKQVNVLGTDVVRQSILRRSPGAEEVQSQEQTRQDAEKSDTSPVAGKKASHDGPKRKGFLLSKFRSATRGEIITPKTDTGRSYSLDLDGQHFRSLKSPPGSDRGSTGSSDLNDQEPGPRTPKSSRSNGVTPGTQSSPAPSTRTVTSVISREYGFENSMDLAAIEGTSQELTKSHRRNTSGTPSIAVSGTSLSSDQSRSELDLSESFTEDSEDTVSIRSKSVPGALDKDSLEETEESIDALVSSQLSTNTHRLASGLSTSSQAGSDRKWTYLNVPDADSDTTSLNSMMSVYSETGDYGNVKVSGEILLHISYCYKTGGLYIFVKNCRNLAIGDEKKQRTDAYVKSYLLPDKSRNNKRKTKIRTGTNPEFNETLKYTISHTQLETRTLQLSVWHYDRFGRNSFLGEVEIPFDSWNFENPTDEWFVLQPKVEFAPDIGLQYKGELTVVLRYIPPEENLMLPPEQLQGNKTFKKGKKKESPVISGGILEVFIKEAKNLTAVKSGGTSDSFVKGYLLPDDSKATKHKTLVIKKSVNPQWNHTFMFSGIHPQDIKNVCLELTIWDKEAFSSNIFLGGVRLNSGSGVSHGKNVDWMDSQGEEQRLWQKMANNPGTPFEGVLMLRSSMGKCRL

SEQ ID NO: 85814 - protein, 476 aa, Homo sapiens
  Payload ID: 17046
  Gene Symbol: SYNC
  Gene Name: syncoilin, intermediate filament protein
  Uniprot ID: Q9H7C4
  ENSP ID: ENSP00000362583
MASPEPRRGGDGAAQAARKTRVEANSPLPKNSGSLNEAEALNPEVTLSSEGSLNLEDILYLEDTGDLDETLYVQETEKAEEALYIEEAMQPDEALHVEEPGNPEETVCVEETTEPDRIQFVEGPVEPGKPTSPEHVVYEGETVTRAEKSNPEESLRAEQSPSMEENLSIEDLELLEGRFQQCVQAVAQLEEERDQLIHELVLLREPALQEVQQVHQDILAAYKLHAQAELERDGLREEIRLVKQKLFKVTKECVAYQYQLECRQQDVAQFADFREVLTTRATQLSEELAQLRDAYQKQKEQLRQQLEAPPSQRDGHFLQESRRLSAQFENLMAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKGCLEIYGQICNPETAKNFLAKDH

SEQ ID NO: 85815 - protein, 482 aa, Homo sapiens
  Payload ID: 17046
  Gene Symbol: SYNC
  Gene Name: syncoilin, intermediate filament protein
  Uniprot ID: Q9H7C4
  ENSP ID: ENSP00000386439
MASPEPRRGGDGAAQAARKTRVEANSPLPKNSGSLNEAEALNPEVTLSSEGSLNLEDILYLEDTGDLDETLYVQETEKAEEALYIEEAMQPDEALHVEEPGNPEETVCVEETTEPDRIQFVEGPVEPGKPTSPEHVVYEGETVTRAEKSNPEESLRAEQSPSMEENLSIEDLELLEGRFQQCVQAVAQLEEERDQLIHELVLLREPALQEVQQVHQDILAAYKLHAQAELERDGLREEIRLVKQKLFKVTKECVAYQYQLECRQQDVAQFADFREVLTTRATQLSEELAQLRDAYQKQKEQLRQQLEAPPSQRDGHFLQESRRLSAQFENLMAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKAMLLPKSLEQADAPTSQAGGMETQSQGAV

SEQ ID NO: 85816 - protein, 70 aa, Homo sapiens
  Payload ID: 17046
  Gene Symbol: SYNC
  Gene Name: syncoilin, intermediate filament protein
  ENSP ID: ENSP00000387594
MQPDEALHVEEPGNPEETVCVEETTEPDRIQFVEGPVEPGKPTSPEHVVYEGETVTRAEKSNPEESLRAE

SEQ ID NO: 85817 - protein, 89 aa, Homo sapiens
  Payload ID: 17046
  Gene Symbol: SYNC
  Gene Name: syncoilin, intermediate filament protein
  ENSP ID: ENSP00000401975
MQPDEALHVEEPGNPEETVCVEETTEPDRIQFVEGPVEPGKPTSPEHVVYEGETVTRAEKSNPEESLRAEQSPSMEENLSIEDLELLEG

SEQ ID NO: 85818 - protein, 134 aa, Homo sapiens
  Payload ID: 17047
  Gene Symbol: SYCN
  Gene Name: syncollin
  Uniprot ID: Q0VAF6
  ENSP ID: ENSP00000325564
MSPLRPLLLALALASVPCAQGACPASADLKHSDGTRTCAKLYDKSDPYYENCCGGAELSLESGADLPYLPSNWANTASSLVVAPRCELTVWSRQGKAGKTHKFSAGTYPRLEEYRRGILGDWSNAISALYCRCS

SEQ ID NO: 85819 - protein, 310 aa, Homo sapiens
  Payload ID: 17048
  Gene Symbol: SDC1
  Gene Name: syndecan 1
  Uniprot ID: P18827
  ENSP ID: ENSP00000254351
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 85820 - protein, 310 aa, Homo sapiens; identical to SEQ ID NO: 85819
  Payload ID: 17048
  Gene Symbol: SDC1
  Gene Name: syndecan 1
  Uniprot ID: P18827
  ENSP ID: ENSP00000370542

SEQ ID NO: 85821 - protein, 169 aa, Homo sapiens
  Payload ID: 17048
  Gene Symbol: SDC1
  Gene Name: syndecan 1
  ENSP ID: ENSP00000384613
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPVHFVSWGGLI

SEQ ID NO: 85822 - protein, 28 aa, Homo sapiens
  Payload ID: 17048
  Gene Symbol: SDC1
  Gene Name: syndecan 1
  ENSP ID: ENSP00000390201
MRRAALWLWLCALALSLQPALPSLSHGR

SEQ ID NO: 85823 - protein, 215 aa, Homo sapiens
  Payload ID: 17048
  Gene Symbol: SDC1
  Gene Name: syndecan 1
  ENSP ID: ENSP00000400773
PRWPGEPGQGCVGGAGERLQGPRACRGRLEQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSG

SEQ ID NO: 85824 - protein, 201 aa, Homo sapiens
  Payload ID: 17049
  Gene Symbol: SDC2
  Gene Name: syndecan 2
  Uniprot ID: P34741
  ENSP ID: ENSP00000307046
MRRAWILLTLGLVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 85825 - protein, 172 aa, Homo sapiens
  Payload ID: 17049
  Gene Symbol: SDC2
  Gene Name: syndecan 2
  ENSP ID: ENSP00000427784
MYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 85826 - protein, 172 aa, Homo sapiens; identical to SEQ ID NO: 85825
  Payload ID: 17049
  Gene Symbol: SDC2
  Gene Name: syndecan 2
  ENSP ID: ENSP00000428256

SEQ ID NO: 85827 - protein, 165 aa, Homo sapiens
  Payload ID: 17049
  Gene Symbol: SDC2
  Gene Name: syndecan 2
  ENSP ID: ENSP00000429045
MRRAWILLTLGLVACVSAESVRADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 85828 - protein, 137 aa, Homo sapiens
  Payload ID: 17049
  Gene Symbol: SDC2
  Gene Name: syndecan 2
  ENSP ID: ENSP00000429121
MYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILL

SEQ ID NO: 85829 - protein, 145 aa, Homo sapiens
  Payload ID: 17049
  Gene Symbol: SDC2
  Gene Name: syndecan 2
  ENSP ID: ENSP00000429662
MYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKK

SEQ ID NO: 85830 - protein, 384 aa, Homo sapiens
  Payload ID: 17050
  Gene Symbol: SDC3
  Gene Name: syndecan 3
  ENSP ID: ENSP00000338346
MAIAYLGSSCPSQPPSSLALSLSPTPSDFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 85831 - protein, 442 aa, Homo sapiens
  Payload ID: 17050
  Gene Symbol: SDC3
  Gene Name: syndecan 3
  Uniprot ID: O75056
  ENSP ID: ENSP00000344468
MKPGPPHRAGAAHGAGAGAGAAAGPGARGLLLPPLLLLLLAGRAAGAQRWRSENFERPVDLEGSGDDDSFPDDELDDLYSGSGSGYFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 85832 - protein, 198 aa, Homo sapiens
  Payload ID: 17051
  Gene Symbol: SDC4
  Gene Name: syndecan 4
  Uniprot ID: P31431
  ENSP ID: ENSP00000361818
MAPARLFALLLFFVGGVAESIRETEVIDPQDLLEGRYFSGALPDDEDVVGPGQESDDFELSGSGDLDDLEDSMIGPEVVHPLVPLDNHIPERAGSGSQVPTEPKKLEENEVIPKRISPVEESEDVSNKVSMSSTVQGSNIFERTEVLAALIVGGIVGILFAVFLILLLMYRMKKKDEGSYDLGKKPIYKKAPTNEFYA

SEQ ID NO: 85833 - protein, 298 aa, Homo sapiens
  Payload ID: 17052
  Gene Symbol: SDCBP
  Gene Name: syndecan binding protein (syntenin)
  Uniprot ID: O00560
  ENSP ID: ENSP00000260130
MSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 85834 - protein, 292 aa, Homo sapiens
  Payload ID: 17052
  Gene Symbol: SDCBP
  Gene Name: syndecan binding protein (syntenin)
  Uniprot ID: O00560
  ENSP ID: ENSP00000395351
MSLYPSLEDLKAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 85835 - protein, 244 aa, Homo sapiens
  Payload ID: 17052
  Gene Symbol: SDCBP
  Gene Name: syndecan binding protein (syntenin)
  ENSP ID: ENSP00000397820
MSLYPSLEDLKVDKVIQAQTAFSANPANPAILSEASAPIPHDGNLYPRLYPELSQYMGLSLNEEEIRANVAVVSGAPLQGGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 85836 - protein, 297 aa, Homo sapiens
  Payload ID: 17052
  Gene Symbol: SDCBP
  Gene Name: syndecan binding protein (syntenin)
  Uniprot ID: O00560
  ENSP ID: ENSP00000409288
MSLYPSLEDLKVDKVIQAQTAFSANPANPAILSEASAPIPHDGNLYPRLYPELSQYMGLSLNEEEIRANVAVVSGAPLQGLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 85837 - protein, 298 aa, Homo sapiens; identical to SEQ ID NO: 85833
  Payload ID: 17052
  Gene Symbol: SDCBP
  Gene Name: syndecan binding protein (syntenin)
  Uniprot ID: O00560
  ENSP ID: ENSP00000411771

SEQ ID NO: 85838 - protein, 318 aa, Homo sapiens
  Payload ID: 17052
  Gene Symbol: SDCBP
  Gene Name: syndecan binding protein (syntenin)
  ENSP ID: ENSP00000428184
MIKLWTNRDLHIIVMVKNPAKMSLYPSLEDLKVDKVIQAQTAFSANPANPAILSEASAPIPHDGNLYPRLYPELSQYMGLSLNEEEIRANVAVVSGAPLQGLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 85839 - protein, 239 aa, Homo sapiens
  Payload ID: 17052
  Gene Symbol: SDCBP
  Gene Name: syndecan binding protein (syntenin)
  ENSP ID: ENSP00000430730
MSLYPSLEDLKVDKVIQAQTAFSANPANPAILSEASAPIPHDGNLYPRLYPELSQYMGLSLNEEEIRANVAVVSGAPLQGLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 85840 - protein, 318 aa, Homo sapiens; identical to SEQ ID NO: 85838
  Payload ID: 17052
  Gene Symbol: SDCBP
  Gene Name: syndecan binding protein (syntenin)
  ENSP ID: ENSP00000487245

SEQ ID NO: 85841 - protein, 292 aa, Homo sapiens
  Payload ID: 17053
  Gene Symbol: SDCBP2
  Gene Name: syndecan binding protein (syntenin) 2
  Uniprot ID: Q9H190
  ENSP ID: ENSP00000342935
MSSLYPSLEDLKVDQAIQAQVRASPKMPALPVQATAISPPPVLYPNLAELENYMGLSLSSQEVQESLLQIPEGDSTAVSGPGPGQMVAPVTGYSLGVRRAEIKPGVREIHLCKDERGKTGLRLRKVDQGLFVQLVQANTPASLVGLRFGDQLLQIDGRDCAGWSSHKAHQVVKKASGDKIVVVVRDRPFQRTVTMHKDSMGHVGFVIKKGKIVSLVKGSSAARNGLLTNHYVCEVDGQNVIGLKDKKIMEILATAGNVVTLTIIPSVIYEHMVKKLPPVLLHHTMDHSIPDA

SEQ ID NO: 85842 - protein, 292 aa, Homo sapiens; identical to SEQ ID NO: 85841
  Payload ID: 17053
  Gene Symbol: SDCBP2
  Gene Name: syndecan binding protein (syntenin) 2
  Uniprot ID: Q9H190
  ENSP ID: ENSP00000354013

SEQ ID NO: 85843 - protein, 207 aa, Homo sapiens
  Payload ID: 17053
  Gene Symbol: SDCBP2
  Gene Name: syndecan binding protein (syntenin) 2
  Uniprot ID: Q9H190
  ENSP ID: ENSP00000371229
MVAPVTGYSLGVRRAEIKPGVREIHLCKDERGKTGLRLRKVDQGLFVQLVQANTPASLVGLRFGDQLLQIDGRDCAGWSSHKAHQVVKKASGDKIVVVVRDRPFQRTVTMHKDSMGHVGFVIKKGKIVSLVKGSSAARNGLLTNHYVCEVDGQNVIGLKDKKIMEILATAGNVVTLTIIPSVIYEHMVKKLPPVLLHHTMDHSIPDA

SEQ ID NO: 85844 - protein, 292 aa, Homo sapiens; identical to SEQ ID NO: 85841
  Payload ID: 17053
  Gene Symbol: SDCBP2
  Gene Name: syndecan binding protein (syntenin) 2
  Uniprot ID: Q9H190
  ENSP ID: ENSP00000371233

SEQ ID NO: 85845 - protein, 339 aa, Homo sapiens
  Payload ID: 17054
  Gene Symbol: SYNM
  Gene Name: synemin, intermediate filament protein
  ENSP ID: ENSP00000330469
MLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAEALRREALGLEQLRARLEDALLRMREEYGIQAEERQRVIDCLEDEKATLTLAMADWLRDYQDLLQVKTGLSLEVATYRALLEGESNPEIVIWAEHVENMPSDGCE

SEQ ID NO: 85846 - protein, 1565 aa, Homo sapiens
  Payload ID: 17054
  Gene Symbol: SYNM
  Gene Name: synemin, intermediate filament protein
  Uniprot ID: O15061
  ENSP ID: ENSP00000336775
MLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAEALRREALGLEQLRARLEDALLRMREEYGIQAEERQRVIDCLEDEKATLTLAMADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSPKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEVSAGGDLSQAASPTGASRSVRHVTLGPGQSPLSREVIFLGPAPACPEAWGSPEPGPAESSADMDGSGRHSTFGCRQFHAEKEIIFQGPISAAGKVGDYFATEESVGTQTSVRQLQLGPKEGFSGQIQFTAPLSDKVELGVIGDSVHMEGLPGSSTSIRHISIGPQRHQTTQQIVYHGLVPQLGESGDSESTVHGEGSADVHQATHSHTSGRQTVMTEKSTFQSVVSESPQEDSAEDTSGAEMTSGVSRSFRHIRLGPTETETSEHIAIRGPVSRTFVLAGSADSPELGKLADSSRTLRHIAPGPKETSFTFQMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 85847 - protein, 967 aa, Homo sapiens
  Payload ID: 17054
  Gene Symbol: SYNM
  Gene Name: synemin, intermediate filament protein
  ENSP ID: ENSP00000453040
MADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSPKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 85848 - protein, 1253 aa, Homo sapiens
  Payload ID: 17054
  Gene Symbol: SYNM
  Gene Name: synemin, intermediate filament protein
  ENSP ID: ENSP00000472953
MLSWRLQTGPEKAELQELNARLYDYVCRVRELERENLLLEEELRGRRGREGLWAEGQARCAEEARSLRQQLDELSWATALAEGERDALRRELRELQRLDAEERAARGRLDAELGAQQRELQEALGARAALEALLGRLQAERRGLDAAHERDVRELRARAASLTMHFRARATGPAAPPPRLREVHDSYALLVAESWRETVQLYEDEVRELEEALRRGQESRLQAEEETRLCAQEAEALRREALGLEQLRARLEDALLRMREEYGIQAEERQRVIDCLEDEKATLTLAMADWLRDYQDLLQVKTGLSLEVATYRALLEGESNPEIVIWAEHVENMPSEFRNKSYHYTDSLLQRENERNLFSRQKAPLASFNHSSALYSNLSGHRGSQTGTSIGGDARRGFLGSGYSSSATTQQENSYGKAVSSQTNVRTFSPTYGLLRNTEAQVKTFPDRPKAGDTREVPVYIGEDSTIARESYRDRRDKVAAGASESTRSNERTVILGKKTEVKATREQERNRPETIRTKPEEKMFDSKEKASEERNLRWEELTKLDKEARQRESQQMKEKAKEKDSPKEKSVREREVPISLEVSQDRRAEVSPKGLQTPVKDAGGGTGREAEARELRFRLGTSDATGSLQGDSMTETVAENIVTSILKQFTQSPETEASADSFPDTKVTYVDRKELPGERKTKTEIVVESKLTEDVDVSDEAGLDYLLSKDIKEVGLKGKSAEQMIGDIINLGLKGREGRAKVVNVEIVEEPVSYVSGEKPEEFSVPFKVEEVEDVSPGPWGLVKEEEGYGESDVTFSVNQHRRTKQPQENTTHVEEVTEAGDSEGEQSYFVSTPDEHPGGHDRDDGSVYGQIHIEEESTIRYSWQDEIVQGTRRRTQKDGAVGEKVVKPLDVPAPSLEGDLGSTHWKEQARSGEFHAEPTVIEKEIKIPHEFHTSMKGISSKEPRQQLVEVIGQLEETLPERMREELSALTREGQGGPGSVSVDVKKVQGAGGSSVTLVAEVNVSQTVDADRLDLEELSKDEASEMEKAVESVVRESLSRQRSPAPGSPDEEGGAEAPAAGIRFRRWATRELYIPSGESEVAGGASHSSGQRTPQGPVSATVEVSSPTGFAQSQVLEDVSQAARHIKLGPSEVWRTERMSYEGPTAEVVEMDVSNVEAIRSRTQEAGALGVSDRGSWRDADSRNDQAVGVSFKASAGEGDQAHREQGKEQAMFDKKVQLQRMVDQRSVISDEKKVALLYLDNEEEENDGHWF

SEQ ID NO: 85849 - protein, 1235 aa, Homo sapiens
  Payload ID: 17055
  Gene Symbol: SYNRG
  Gene Name: synergin, gamma
  Uniprot ID: Q9UMZ2
  ENSP ID: ENSP00000477885
MALRPGAGSGGGGAAGAGAGSAGGGGFMFPVAGGIRPPQGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 85850 - protein, 1108 aa, Homo sapiens
  Payload ID: 17055
  Gene Symbol: SYNRG
  Gene Name: synergin, gamma
  Uniprot ID: Q9UMZ2
  ENSP ID: ENSP00000478707
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 85851 - protein, 107 aa, Homo sapiens
  Payload ID: 17055
  Gene Symbol: SYNRG
  Gene Name: synergin, gamma
  ENSP ID: ENSP00000480047
  MOD_RES (1)..(1): Any amino acid
XQKLLEEERKRRQFEEQKQKLRLLSSVKPKTGEKSRDDALEAIKGNLDGFSRDAKMHPTPASHPKKPGSFKRHYIFLFWEGDLCSPCFFTSPLYVCVKSQCRTLPSS

SEQ ID NO: 85852 - protein, 1314 aa, Homo sapiens
  Payload ID: 17055
  Gene Symbol: SYNRG
  Gene Name: synergin, gamma
  Uniprot ID: Q9UMZ2
  ENSP ID: ENSP00000480288
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 85853 - protein, 1108 aa, Homo sapiens; identical to SEQ ID NO: 85850
  Payload ID: 17055
  Gene Symbol: SYNRG
  Gene Name: synergin, gamma
  Uniprot ID: Q9UMZ2
  ENSP ID: ENSP00000481151

SEQ ID NO: 85854 - protein, 1224 aa, Homo sapiens
  Payload ID: 17055
  Gene Symbol: SYNRG
  Gene Name: synergin, gamma
  Uniprot ID: Q9UMZ2
  ENSP ID: ENSP00000482597
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 85855 - protein, 125 aa, Homo sapiens
  Payload ID: 17055
  Gene Symbol: SYNRG
  Gene Name: synergin, gamma
  ENSP ID: ENSP00000482631
MFPVAGGIRPPQGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLL

SEQ ID NO: 85856 - protein, 236 aa, Homo sapiens
  Payload ID: 17055
  Gene Symbol: SYNRG
  Gene Name: synergin, gamma
  ENSP ID: ENSP00000482858
ETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQALEQPFRDRSNTLNEKPALPVIRDKYKDLTGEVEENERYAYEWQRCLGSALNVIKKANDTLNGISSSSVCTEVIQSAQGMEYLLGVVEVYRVTKRVEL

SEQ ID NO: 85857 - protein, 1179 aa, Homo sapiens
  Payload ID: 17055
  Gene Symbol: SYNRG
  Gene Name: synergin, gamma
  Uniprot ID: Q9UMZ2
  ENSP ID: ENSP00000482962
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 85858 - protein, 1259 aa, Homo sapiens
  Payload ID: 17055
  Gene Symbol: SYNRG
  Gene Name: synergin, gamma
  Uniprot ID: Q9UMZ2
  ENSP ID: ENSP00000483063
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTCCWEKMTVITKHLSPYHELLEEKPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 85859 - protein, 1259 aa, Homo sapiens; identical to SEQ ID NO: 85858
  Payload ID: 17055
  Gene Symbol: SYNRG
  Gene Name: synergin, gamma
  Uniprot ID: Q9UMZ2
  ENSP ID: ENSP00000483152

SEQ ID NO: 85860 - protein, 1314 aa, Homo sapiens; identical to SEQ ID NO: 85852
  Payload ID: 17055
  Gene Symbol: SYNRG
  Gene Name: synergin, gamma
  Uniprot ID: Q9UMZ2
  ENSP ID: ENSP00000483453

SEQ ID NO: 85861 - protein, 1224 aa, Homo sapiens; identical to SEQ ID NO: 85854
  Payload ID: 17055
  Gene Symbol: SYNRG
  Gene Name: synergin, gamma
  Uniprot ID: Q9UMZ2
  ENSP ID: ENSP00000484529

SEQ ID NO: 85862 - protein, 1179 aa, Homo sapiens; identical to SEQ ID NO: 85857
  Payload ID: 17055
  Gene Symbol: SYNRG
  Gene Name: synergin, gamma
  Uniprot ID: Q9UMZ2
  ENSP ID: ENSP00000487672

SEQ ID NO: 85863 - protein, 125 aa, Homo sapiens; identical to SEQ ID NO: 85855
  Payload ID: 17055
  Gene Symbol: SYNRG
  Gene Name: synergin, gamma
  ENSP ID: ENSP00000488089

SEQ ID NO: 85864 - protein, 1235 aa, Homo sapiens; identical to SEQ ID NO: 85849
  Payload ID: 17055
  Gene Symbol: SYNRG
  Gene Name: synergin, gamma
  Uniprot ID: Q9UMZ2
  ENSP ID: ENSP00000488473

SEQ ID NO: 85865 - protein, 107 aa, Homo sapiens; identical to SEQ ID NO: 85851
  Payload ID: 17055
  Gene Symbol: SYNRG
  Gene Name: synergin, gamma
  ENSP ID: ENSP00000488863
  MOD_RES (1)..(1): Any amino acid

SEQ ID NO: 85866 - protein, 40 aa, Homo sapiens
  Payload ID: 17056
  Gene Symbol: SYNJ2BP-COX16
  Gene Name: SYNJ2BP-COX16 readthrough
  ENSP ID: ENSP00000477705
MNGRVDYLVTEEEINLTRGPSGKWPRPKEPAAPGCCRPLS

SEQ ID NO: 85867 - protein, 186 aa, Homo sapiens
  Payload ID: 17056
  Gene Symbol: SYNJ2BP-COX16
  Gene Name: SYNJ2BP-COX16 readthrough
  ENSP ID: ENSP00000478757
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLQVQNGPIGHRGEGDPSGIPIFMVLVPVFALTMMDPELEKKLKENKISLESEYEKIKDSKFDDWKNIRGPRPWEDPDLLQGRNPESL

SEQ ID NO: 85868 - protein, 53 aa, Homo sapiens
  Payload ID: 17056
  Gene Symbol: SYNJ2BP-COX16
  Gene Name: SYNJ2BP-COX16 readthrough
  ENSP ID: ENSP00000480746
MDPELEKKLKENKISLESEYEKIKDSKFDDWKNIRGPRPWEDPDLLQGRNPES

SEQ ID NO: 85869 - protein, 182 aa, Homo sapiens
  Payload ID: 17056
  Gene Symbol: SYNJ2BP-COX16
  Gene Name: SYNJ2BP-COX16 readthrough
  ENSP ID: ENSP00000482133
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLLIVGGSFGLREFSQIRYDAVKSKMDPELEKKLKENKISLESEYEKIKDSKFDDWKNIRGPRPWEDPDLLQGRNPESLKTKTT

SEQ ID NO: 85870 - protein, 152 aa, Homo sapiens
  Payload ID: 17056
  Gene Symbol: SYNJ2BP-COX16
  Gene Name: SYNJ2BP-COX16 readthrough
  ENSP ID: ENSP00000484161
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRMDPELEKKLKENKISLESEYEKIKDSKFDDWKNIRGPRPWEDPDLLQGRNPES

SEQ ID NO: 85871 - protein, 616 aa, Homo sapiens
  Payload ID: 17057
  Gene Symbol: SYVN1
  Gene Name: synovial apoptosis inhibitor 1, synoviolin
  Uniprot ID: Q86TM6
  ENSP ID: ENSP00000294256
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 85872 - protein, 565 aa, Homo sapiens
  Payload ID: 17057
  Gene Symbol: SYVN1
  Gene Name: synovial apoptosis inhibitor 1, synoviolin
  Uniprot ID: Q86TM6
  ENSP ID: ENSP00000302035
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 85873 - protein, 617 aa, Homo sapiens
  Payload ID: 17057
  Gene Symbol: SYVN1
  Gene Name: synovial apoptosis inhibitor 1, synoviolin
  Uniprot ID: Q86TM6
  ENSP ID: ENSP00000366395
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 85874 - protein, 236 aa, Homo sapiens
  Payload ID: 17057
  Gene Symbol: SYVN1
  Gene Name: synovial apoptosis inhibitor 1, synoviolin
  ENSP ID: ENSP00000431215
MGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICRE

SEQ ID NO: 85875 - protein, 237 aa, Homo sapiens
  Payload ID: 17057
  Gene Symbol: SYVN1
  Gene Name: synovial apoptosis inhibitor 1, synoviolin
  ENSP ID: ENSP00000431720
MFRTAVMMAASLALTGAVVAHAYYLKHQFYPTVVYLTKSSPSMAVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAM

SEQ ID NO: 85876 - protein, 149 aa, Homo sapiens
  Payload ID: 17057
  Gene Symbol: SYVN1
  Gene Name: synovial apoptosis inhibitor 1, synoviolin
  ENSP ID: ENSP00000432166
  MOD_RES (1)..(1): Any amino acid
XVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVLCHPDDDGAHHLHQVCAALRGPPE

SEQ ID NO: 85877 - protein, 149 aa, Homo sapiens
  Payload ID: 17057
  Gene Symbol: SYVN1
  Gene Name: synovial apoptosis inhibitor 1, synoviolin
  ENSP ID: ENSP00000432888
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSTPITAS

SEQ ID NO: 85878 - protein, 616 aa, Homo sapiens; identical to SEQ ID NO: 85871
  Payload ID: 17057
  Gene Symbol: SYVN1
  Gene Name: synovial apoptosis inhibitor 1, synoviolin
  Uniprot ID: Q86TM6
  ENSP ID: ENSP00000436984

SEQ ID NO: 85879 - protein, 396 aa, Homo sapiens
  Payload ID: 17058
  Gene Symbol: SS18L1
  Gene Name: synovial sarcoma translocation gene on chromosome 18-like 1
  Uniprot ID: O75177
  ENSP ID: ENSP00000333012
MSVAFASARPRGKGEVTQQTIQKMLDENHHLIQCILEYQSKGKTAECTQYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 85880 - protein, 314 aa, Homo sapiens
  Payload ID: 17058
  Gene Symbol: SS18L1
  Gene Name: synovial sarcoma translocation gene on chromosome 18-like 1
  Uniprot ID: O75177
  ENSP ID: ENSP00000359885
MNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 85881 - protein, 128 aa, Homo sapiens
  Payload ID: 17058
  Gene Symbol: SS18L1
  Gene Name: synovial sarcoma translocation gene on chromosome 18-like 1
  ENSP ID: ENSP00000398634
MQSLSTEARYVPRVPQHRDQISPRSPQHGGQICPRSPLHRGQICPRSPPARRYQQILHRNLVYLATIADSNQNMQSLLPAPPTQNMNLGPGALTQSGSSQGLHSQGSLSDAISTGLPPSSLLQGQIGN

SEQ ID NO: 85882 - protein, 211 aa, Homo sapiens
  Payload ID: 17058
  Gene Symbol: SS18L1
  Gene Name: synovial sarcoma translocation gene on chromosome 18-like 1
  ENSP ID: ENSP00000434451
  MOD_RES (1)..(1): Any amino acid
XSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 85883 - protein, 77 aa, Homo sapiens
  Payload ID: 17059
  Gene Symbol: SS18L2
  Gene Name: synovial sarcoma translocation gene on chromosome 18-like 2
  Uniprot ID: Q9UHA2
  ENSP ID: ENSP00000011691
MSVAFVPDWLRGKAEVNQETIQRLLEENDQLIRCIVEYQNKGRGNECVQYQHVLHRNLIYLATIADASPTSTSKAME

SEQ ID NO: 85884 - protein, 77 aa, Homo sapiens; identical to SEQ ID NO: 85883
  Payload ID: 17059
  Gene Symbol: SS18L2
  Gene Name: synovial sarcoma translocation gene on chromosome 18-like 2
  Uniprot ID: Q9UHA2
  ENSP ID: ENSP00000401115

SEQ ID NO: 85885 - protein, 387 aa, Homo sapiens
  Payload ID: 17060
  Gene Symbol: SS18
  Gene Name: synovial sarcoma translocation, chromosome 18
  Uniprot ID: Q15532
  ENSP ID: ENSP00000269137
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 85886 - protein, 61 aa, Homo sapiens
  Payload ID: 17060
  Gene Symbol: SS18
  Gene Name: synovial sarcoma translocation, chromosome 18
  ENSP ID: ENSP00000269138
MSVAFAAPRQRGKGEITPAAIQKMLDDNNHLIQCIMDSQNKGKTSECSHHPHRICLWVLEG

SEQ ID NO: 85887 - protein, 418 aa, Homo sapiens
  Payload ID: 17060
  Gene Symbol: SS18
  Gene Name: synovial sarcoma translocation, chromosome 18
  Uniprot ID: Q15532
  ENSP ID: ENSP00000414516
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 85888 - protein, 395 aa, Homo sapiens
  Payload ID: 17060
  Gene Symbol: SS18
  Gene Name: synovial sarcoma translocation, chromosome 18
  ENSP ID: ENSP00000438066
MLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 85889 - protein, 41 aa, Homo sapiens
  Payload ID: 17060
  Gene Symbol: SS18
  Gene Name: synovial sarcoma translocation, chromosome 18
  ENSP ID: ENSP00000441760
MSVAFAAPRQRGKGEITPAAIQKVSADVAHKLGIPCYNSRF

SEQ ID NO: 85890 - protein, 58 aa, Homo sapiens
  Payload ID: 17060
  Gene Symbol: SS18
  Gene Name: synovial sarcoma translocation, chromosome 18
  ENSP ID: ENSP00000462104
MSVAFAAPRQRGKGEITPAAIQKMLDDNNHLIQCIMDSQNKGKTSECSQVSPNYSRVA

SEQ ID NO: 85891 - protein, 58 aa, Homo sapiens; identical to SEQ ID NO: 85890
  Payload ID: 17060
  Gene Symbol: SS18
  Gene Name: synovial sarcoma translocation, chromosome 18
  ENSP ID: ENSP00000462363

SEQ ID NO: 85892 - protein, 152 aa, Homo sapiens
  Payload ID: 17060
  Gene Symbol: SS18
  Gene Name: synovial sarcoma translocation, chromosome 18
  ENSP ID: ENSP00000462766
MLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPV

SEQ ID NO: 85893 - protein, 84 aa, Homo sapiens
  Payload ID: 17060
  Gene Symbol: SS18
  Gene Name: synovial sarcoma translocation, chromosome 18
  ENSP ID: ENSP00000462838
MSVAFAAPRQRGKGEITPAAIQKMLDDNNHLIQCIMDSQNKGKTSECSQVMNKPHLLVWFGQWSSENLMSCNHTNTQAKENLKA

SEQ ID NO: 85894 - protein, 70 aa, Homo sapiens
  Payload ID: 17060
  Gene Symbol: SS18
  Gene Name: synovial sarcoma translocation, chromosome 18
  ENSP ID: ENSP00000463586
MLDDNNHLIQCIMDSQNKGKTSECSQYQQMLHTNLVYLATIADSNQNMQSLLPAPPTQNMPMGPGGMNQS

SEQ ID NO: 85895 - protein, 68 aa, Homo sapiens
  Payload ID: 17060
  Gene Symbol: SS18
  Gene Name: synovial sarcoma translocation, chromosome 18
  ENSP ID: ENSP00000463802
MSVAFAAPRQRGKGEITPAAIQKMLDDNNHLIQCIMDSQNKGKTSECSHWRLPIHCLLYMLCPDRWVV

SEQ ID NO: 85896 - protein, 94 aa, Homo sapiens
  Payload ID: 17060
  Gene Symbol: SS18
  Gene Name: synovial sarcoma translocation, chromosome 18
  ENSP ID: ENSP00000463928
MSVAFAAPRQRGKGEITPAAIQKMLDDNNHLIQCIMDSQNKGKTSECSHTKIGWTWWWIPVIPTAWEAEAGESLEPGRRRLQVSQDRTTALQPS

SEQ ID NO: 85897 - protein, 55 aa, Homo sapiens
  Payload ID: 17060
  Gene Symbol: SS18
  Gene Name: synovial sarcoma translocation, chromosome 18
  ENSP ID: ENSP00000463933
MLDDNNHLIQCIMDSQNKGKTSECSQYQQMLHTNLVYLATIADSNQNMQSLLPAV

SEQ ID NO: 85898 - protein, 130 aa, Homo sapiens
  Payload ID: 17060
  Gene Symbol: SS18
  Gene Name: synovial sarcoma translocation, chromosome 18
  ENSP ID: ENSP00000463943
MLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMP

SEQ ID NO: 85899 - protein, 60 aa, Homo sapiens
  Payload ID: 17060
  Gene Symbol: SS18
  Gene Name: synovial sarcoma translocation, chromosome 18
  ENSP ID: ENSP00000464049
MSVAFAAPRQRGKGEITPAAIQKMLDDNNHLIQCIMDSQNKGKTSECSQSGQWEPLKLAS

SEQ ID NO: 85900 - protein, 60 aa, Homo sapiens; identical to SEQ ID NO: 85899
  Payload ID: 17060
  Gene Symbol: SS18
  Gene Name: synovial sarcoma translocation, chromosome 18
  ENSP ID: ENSP00000464556

SEQ ID NO: 85901 - protein, 35 aa, Homo sapiens
  Payload ID: 17060
  Gene Symbol: SS18
  Gene Name: synovial sarcoma translocation, chromosome 18
  ENSP ID: ENSP00000464609
MLDDNNHLIQCIMDSQNKGKTSECSQVSPNYSRVA

SEQ ID NO: 85902 - protein, 60 aa, Homo sapiens; identical to SEQ ID NO: 85899
  Payload ID: 17060
  Gene Symbol: SS18
  Gene Name: synovial sarcoma translocation, chromosome 18
  ENSP ID: ENSP00000464664

SEQ ID NO: 85903 - protein, 45 aa, Homo sapiens
  Payload ID: 17060
  Gene Symbol: SS18
  Gene Name: synovial sarcoma translocation, chromosome 18
  ENSP ID: ENSP00000464673
MLDDNNHLIQCIMDSQNKGKTSECSHWRLPIHCLLYMLCPDRWVV

SEQ ID NO: 85904 - protein, 188 aa, Homo sapiens
  Payload ID: 17061
  Gene Symbol: SSX1
  Gene Name: synovial sarcoma, X breakpoint 1
  Uniprot ID: Q16384
  ENSP ID: ENSP00000366118
MNGDDTFAKRPRDDAKASEKRSKAFDDIATYFSKKEWKKMKYSEKISYVYMKRNYKAMTKLGFKVTLPPFMCNKQATDFQGNDFDNDHNRRIQVEHPQMTFGRLHRIIPKIMPKKPAEDENDSKGVSEASGPQNDGKQLHPPGKANISEKINKRSGPKRGKHAWTHRLRERKQLVIYEEISDPEEDDE

SEQ ID NO: 85905 - protein, 188 aa, Homo sapiens
  Payload ID: 17062
  Gene Symbol: SSX2
  Gene Name: synovial sarcoma, X breakpoint 2
  Uniprot ID: Q16385
  ENSP ID: ENSP00000338561
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 85906 - protein, 223 aa, Homo sapiens
  Payload ID: 17062
  Gene Symbol: SSX2
  Gene Name: synovial sarcoma, X breakpoint 2
  Uniprot ID: Q16385
  ENSP ID: ENSP00000338796
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 85907 - protein, 188 aa, Homo sapiens
  Payload ID: 17062
  Gene Symbol: SSX2
  Gene Name: synovial sarcoma, X breakpoint 2
  ENSP ID: ENSP00000479759
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSKGVPEASGSQNDGKHLCPPGKPSTSEKINKTSGPKRGKHAWTHRLRERKQLVIYEEISDPEEDDE

SEQ ID NO: 85908 - protein, 614 aa, Homo sapiens
  Payload ID: 17063
  Gene Symbol: SSX2IP
  Gene Name: synovial sarcoma, X breakpoint 2 interacting protein
  Uniprot ID: Q9Y2D8
  ENSP ID: ENSP00000340279
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGECTNQKWSVASRPGSQEGCYSGCSLSYTNSHVEKDDLP

SEQ ID NO: 85909 - protein, 587 aa, Homo sapiens
  Payload ID: 17063
  Gene Symbol: SSX2IP
  Gene Name: synovial sarcoma, X breakpoint 2 interacting protein
  Uniprot ID: Q9Y2D8
  ENSP ID: ENSP00000412781
MSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGECTNQKWSVASRPGSQEGCYSGCSLSYTNSHVEKDDLP

SEQ ID NO: 85910 - protein, 180 aa, Homo sapiens
  Payload ID: 17063
  Gene Symbol: SSX2IP
  Gene Name: synovial sarcoma, X breakpoint 2 interacting protein
  ENSP ID: ENSP00000416067
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEV

SEQ ID NO: 85911 - protein, 560 aa, Homo sapiens
  Payload ID: 17063
  Gene Symbol: SSX2IP
  Gene Name: synovial sarcoma, X breakpoint 2 interacting protein
  Uniprot ID: Q9Y2D8
  ENSP ID: ENSP00000432261
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHRAKN

SEQ ID NO: 85912 - protein, 87 aa, Homo sapiens
  Payload ID: 17063
  Gene Symbol: SSX2IP
  Gene Name: synovial sarcoma, X breakpoint 2 interacting protein
  ENSP ID: ENSP00000473763
MTTFDHQNSENVKLFSAFSGSSDWDNLIVHSRQPQKKPHSVSNGSPVCMSKLTKSLPASPSTSDFCQTRSCISEHRYLSIGDLFTCF

SEQ ID NO: 85913 - protein, 587 aa, Homo sapiens; identical to SEQ ID NO: 85909
  Payload ID: 17063
  Gene Symbol: SSX2IP
  Gene Name: synovial sarcoma, X breakpoint 2 interacting protein
  Uniprot ID: Q9Y2D8
  ENSP ID: ENSP00000474480

SEQ ID NO: 85914 - protein, 504 aa, Homo sapiens
  Payload ID: 17063
  Gene Symbol: SSX2IP
  Gene Name: synovial sarcoma, X breakpoint 2 interacting protein
  ENSP ID: ENSP00000474925
MGDWMTVTDPESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLEIGFLLLSVLHKKSLLGIHHSSTVSRCGVRRQCNQDYICCLKKKGI

SEQ ID NO: 85915 - protein, 188 aa, Homo sapiens; identical to SEQ ID NO: 85905
  Payload ID: 17064
  Gene Symbol: SSX2B
  Gene Name: synovial sarcoma, X breakpoint 2B
  Uniprot ID: Q16385
  ENSP ID: ENSP00000470740

SEQ ID NO: 85916 - protein, 223 aa, Homo sapiens; identical to SEQ ID NO: 85906
  Payload ID: 17064
  Gene Symbol: SSX2B
  Gene Name: synovial sarcoma, X breakpoint 2B
  Uniprot ID: Q16385
  ENSP ID: ENSP00000477922

SEQ ID NO: 85917 - protein, 188 aa, Homo sapiens; identical to SEQ ID NO: 85905
  Payload ID: 17064
  Gene Symbol: SSX2B
  Gene Name: synovial sarcoma, X breakpoint 2B
  Uniprot ID: Q16385
  ENSP ID: ENSP00000478714

SEQ ID NO: 85918 - protein, 188 aa, Homo sapiens
  Payload ID: 17065
  Gene Symbol: SSX3
  Gene Name: synovial sarcoma, X breakpoint 3
  Uniprot ID: Q99909
  ENSP ID: ENSP00000298396
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGPKRGEHAWTHRLRERKQLVIYEEISDPEEDDE

SEQ ID NO: 85919 - protein, 170 aa, Homo sapiens
  Payload ID: 17065
  Gene Symbol: SSX3
  Gene Name: synovial sarcoma, X breakpoint 3
  Uniprot ID: Q99909
  ENSP ID: ENSP00000366090
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGVLQRYCRFGSRPLQ

SEQ ID NO: 85920 - protein, 202 aa, Homo sapiens
  Payload ID: 17065
  Gene Symbol: SSX3
  Gene Name: synovial sarcoma, X breakpoint 3
  ENSP ID: ENSP00000480427
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGKRKQFRNNPTGFPGDVQVCGLGVWHGSQITLGPGWAEELAQLQMRC

SEQ ID NO: 85921 - protein, 188 aa, Homo sapiens
  Payload ID: 17066
  Gene Symbol: SSX4
  Gene Name: synovial sarcoma, X breakpoint 4
  Uniprot ID: O60224
  ENSP ID: ENSP00000469011
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 85922 - protein, 153 aa, Homo sapiens
  Payload ID: 17066
  Gene Symbol: SSX4
  Gene Name: synovial sarcoma, X breakpoint 4
  Uniprot ID: O60224
  ENSP ID: ENSP00000483262
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKDPKGGNMPGPTDCVRESSWWFMKRSATLRKMTSNSPRGYDTCP

SEQ ID NO: 85923 - protein, 188 aa, Homo sapiens; identical to SEQ ID NO: 85921
  Payload ID: 17067
  Gene Symbol: SSX4B
  Gene Name: synovial sarcoma, X breakpoint 4B
  Uniprot ID: O60224
  ENSP ID: ENSP00000469394

SEQ ID NO: 85924 - protein, 153 aa, Homo sapiens; identical to SEQ ID NO: 85922
  Payload ID: 17067
  Gene Symbol: SSX4B
  Gene Name: synovial sarcoma, X breakpoint 4B
  Uniprot ID: O60224
  ENSP ID: ENSP00000481765

SEQ ID NO: 85925 - protein, 188 aa, Homo sapiens
  Payload ID: 17068
  Gene Symbol: SSX5
  Gene Name: synovial sarcoma, X breakpoint 5
  Uniprot ID: O60225
  ENSP ID: ENSP00000290558
MNGDDAFVRRPRVGSQIPEKMQKAFDDIAKYFSEKEWEKMKASEKIIYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 85926 - protein, 229 aa, Homo sapiens
  Payload ID: 17068
  Gene Symbol: SSX5
  Gene Name: synovial sarcoma, X breakpoint 5
  Uniprot ID: O60225
  ENSP ID: ENSP00000312415
MNGDDAFVRRPRVGSQIPEKMQKHPWRQVCDRGIHLVNLSPFWKVGREPASSIKALLCGRGEARAFDDIAKYFSEKEWEKMKASEKIIYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 85927 - protein, 188 aa, Homo sapiens; identical to SEQ ID NO: 85925
  Payload ID: 17068
  Gene Symbol: SSX5
  Gene Name: synovial sarcoma, X breakpoint 5
  Uniprot ID: O60225
  ENSP ID: ENSP00000366122

SEQ ID NO: 85928 - protein, 128 aa, Homo sapiens
  Payload ID: 17068
  Gene Symbol: SSX5
  Gene Name: synovial sarcoma, X breakpoint 5
  ENSP ID: ENSP00000385051
LITSAAECPHATEVSLEFGNLYQQRKILMYSLSVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 85929 - protein, 188 aa, Homo sapiens
  Payload ID: 17068
  Gene Symbol: SSX5
  Gene Name: synovial sarcoma, X breakpoint 5
  ENSP ID: ENSP00000482104
MNGDDAFARRPRVDAQIPEKIQKAFDDIAKYFSKEEWEKMKASEKILYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 85930 - protein, 188 aa, Homo sapiens
  Payload ID: 17069
  Gene Symbol: SSX7
  Gene Name: synovial sarcoma, X breakpoint 7
  Uniprot ID: Q7RTT5
  ENSP ID: ENSP00000298181
MNGDDAFARRPRAGAQIPEKIQKSFDDIAKYFSKKEWEKMKSLEKISYVYMKRKYEAMTKLGFKATLPPFMHNTGATDLQGNDFDNDRNQGNQVERPQMTFCRLQRIFPKIMPKKPAEEGNDSKGVPEASGSQNDGKHLCPPGKPSTSEKINKTSGPKRGKHAWTHRLRERKQLVIYEEISDPEEDDE

SEQ ID NO: 85931 - protein, 663 aa, Homo sapiens
  Payload ID: 17070
  Gene Symbol: SYBU
  Gene Name: syntabulin (syntaxin-interacting)
  Uniprot ID: Q9NX95
  ENSP ID: ENSP00000276646
MGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85932 - protein, 660 aa, Homo sapiens
  Payload ID: 17070
  Gene Symbol: SYBU
  Gene Name: syntabulin (syntaxin-interacting)
  Uniprot ID: Q9NX95
  ENSP ID: ENSP00000382019
MSNFEKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85933 - protein, 663 aa, Homo sapiens; identical to SEQ ID NO: 85931
  Payload ID: 17070
  Gene Symbol: SYBU
  Gene Name: syntabulin (syntaxin-interacting)
  Uniprot ID: Q9NX95
  ENSP ID: ENSP00000386154

SEQ ID NO: 85934 - protein, 544 aa, Homo sapiens
  Payload ID: 17070
  Gene Symbol: SYBU
  Gene Name: syntabulin (syntaxin-interacting)
  Uniprot ID: Q9NX95
  ENSP ID: ENSP00000386196
MVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85935 - protein, 663 aa, Homo sapiens; identical to SEQ ID NO: 85931
  Payload ID: 17070
  Gene Symbol: SYBU
  Gene Name: syntabulin (syntaxin-interacting)
  Uniprot ID: Q9NX95
  ENSP ID: ENSP00000403544

SEQ ID NO: 85936 - protein, 663 aa, Homo sapiens; identical to SEQ ID NO: 85931
  Payload ID: 17070
  Gene Symbol: SYBU
  Gene Name: syntabulin (syntaxin-interacting)
  Uniprot ID: Q9NX95
  ENSP ID: ENSP00000404369

SEQ ID NO: 85937 - protein, 663 aa, Homo sapiens; identical to SEQ ID NO: 85931
  Payload ID: 17070
  Gene Symbol: SYBU
  Gene Name: syntabulin (syntaxin-interacting)
  Uniprot ID: Q9NX95
  ENSP ID: ENSP00000407118

SEQ ID NO: 85938 - protein, 662 aa, Homo sapiens
  Payload ID: 17070
  Gene Symbol: SYBU
  Gene Name: syntabulin (syntaxin-interacting)
  Uniprot ID: Q9NX95
  ENSP ID: ENSP00000414748
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85939 - protein, 668 aa, Homo sapiens
  Payload ID: 17070
  Gene Symbol: SYBU
  Gene Name: syntabulin (syntaxin-interacting)
  ENSP ID: ENSP00000415654
MGPLRESKMSNFEKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85940 - protein, 162 aa, Homo sapiens
  Payload ID: 17070
  Gene Symbol: SYBU
  Gene Name: syntabulin (syntaxin-interacting)
  ENSP ID: ENSP00000431469
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVH

SEQ ID NO: 85941 - protein, 144 aa, Homo sapiens
  Payload ID: 17070
  Gene Symbol: SYBU
  Gene Name: syntabulin (syntaxin-interacting)
  ENSP ID: ENSP00000431492
MSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLA

SEQ ID NO: 85942 - protein, 76 aa, Homo sapiens
  Payload ID: 17070
  Gene Symbol: SYBU
  Gene Name: syntabulin (syntaxin-interacting)
  ENSP ID: ENSP00000431895
MGPLRESKKEHRVQHHDKEISRSRIPRLILRPHMPQQQHKVSPASESPFSEEESREFNPSSSGRSARTVSSNSFCS

SEQ ID NO: 85943 - protein, 103 aa, Homo sapiens
  Payload ID: 17070
  Gene Symbol: SYBU
  Gene Name: syntabulin (syntaxin-interacting)
  ENSP ID: ENSP00000432291
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFC

SEQ ID NO: 85944 - protein, 662 aa, Homo sapiens; identical to SEQ ID NO: 85938
  Payload ID: 17070
  Gene Symbol: SYBU
  Gene Name: syntabulin (syntaxin-interacting)
  Uniprot ID: Q9NX95
  ENSP ID: ENSP00000432501

SEQ ID NO: 85945 - protein, 204 aa, Homo sapiens
  Payload ID: 17070
  Gene Symbol: SYBU
  Gene Name: syntabulin (syntaxin-interacting)
  ENSP ID: ENSP00000432835
MGPLRESKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLL

SEQ ID NO: 85946 - protein, 544 aa, Homo sapiens; identical to SEQ ID NO: 85934
  Payload ID: 17070
  Gene Symbol: SYBU
  Gene Name: syntabulin (syntaxin-interacting)
  Uniprot ID: Q9NX95
  ENSP ID: ENSP00000432962

SEQ ID NO: 85947 - protein, 662 aa, Homo sapiens; identical to SEQ ID NO: 85938
  Payload ID: 17070
  Gene Symbol: SYBU
  Gene Name: syntabulin (syntaxin-interacting)
  Uniprot ID: Q9NX95
  ENSP ID: ENSP00000433446

SEQ ID NO: 85948 - protein, 533 aa, Homo sapiens
  Payload ID: 17070
  Gene Symbol: SYBU
  Gene Name: syntabulin (syntaxin-interacting)
  ENSP ID: ENSP00000433941
MFAMKVYGAYLLSSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85949 - protein, 76 aa, Homo sapiens; identical to SEQ ID NO: 85942
  Payload ID: 17070
  Gene Symbol: SYBU
  Gene Name: syntabulin (syntaxin-interacting)
  ENSP ID: ENSP00000434061

SEQ ID NO: 85950 - protein, 80 aa, Homo sapiens
  Payload ID: 17070
  Gene Symbol: SYBU
  Gene Name: syntabulin (syntaxin-interacting)
  ENSP ID: ENSP00000434074
MVGEGSIQSSRYKKESKSGLVKPGSEADFSSSSSTGSISAPEVHMSTAGSKRSSSSRNRGPHGRSNGASSHKPGSSPSSP

SEQ ID NO: 85951 - protein, 34 aa, Homo sapiens
  Payload ID: 17070
  Gene Symbol: SYBU
  Gene Name: syntabulin (syntaxin-interacting)
  ENSP ID: ENSP00000434158
MVGEGSIQSSRYKKESKSGLVKPGSEADFSSSSS

SEQ ID NO: 85952 - protein, 73 aa, Homo sapiens
  Payload ID: 17070
  Gene Symbol: SYBU
  Gene Name: syntabulin (syntaxin-interacting)
  ENSP ID: ENSP00000434612
MGPLRESKKEHRVQHHDKEISRSRIPRLILRPHMPQQQHKVSPASESPFSEEESREFNPSSSGRSARTVSSNS

SEQ ID NO: 85953 - protein, 663 aa, Homo sapiens; identical to SEQ ID NO: 85931
  Payload ID: 17070
  Gene Symbol: SYBU
  Gene Name: syntabulin (syntaxin-interacting)
  Uniprot ID: Q9NX95
  ENSP ID: ENSP00000434679

SEQ ID NO: 85954 - protein, 151 aa, Homo sapiens
  Payload ID: 17070
  Gene Symbol: SYBU
  Gene Name: syntabulin (syntaxin-interacting)
  ENSP ID: ENSP00000434840
MGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSS

SEQ ID NO: 85955 - protein, 457 aa, Homo sapiens
  Payload ID: 17070
  Gene Symbol: SYBU
  Gene Name: syntabulin (syntaxin-interacting)
  ENSP ID: ENSP00000434871
MLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85956 - protein, 137 aa, Homo sapiens
  Payload ID: 17070
  Gene Symbol: SYBU
  Gene Name: syntabulin (syntaxin-interacting)
  ENSP ID: ENSP00000435224
MGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKS

SEQ ID NO: 85957 - protein, 35 aa, Homo sapiens
  Payload ID: 17070
  Gene Symbol: SYBU
  Gene Name: syntabulin (syntaxin-interacting)
  ENSP ID: ENSP00000435433
MVGEGSIQSSRYKKESKSGLVKPGSEADFSSSSST

SEQ ID NO: 85958 - protein, 544 aa, Homo sapiens; identical to SEQ ID NO: 85934
  Payload ID: 17070
  Gene Symbol: SYBU
  Gene Name: syntabulin (syntaxin-interacting)
  Uniprot ID: Q9NX95
  ENSP ID: ENSP00000436041

SEQ ID NO: 85959 - protein, 595 aa, Homo sapiens
  Payload ID: 17070
  Gene Symbol: SYBU
  Gene Name: syntabulin (syntaxin-interacting)
  Uniprot ID: Q9NX95
  ENSP ID: ENSP00000436266
MGPFWARKDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 85960 - protein, 95 aa, Homo sapiens
  Payload ID: 17070
  Gene Symbol: SYBU
  Gene Name: syntabulin (syntaxin-interacting)
  ENSP ID: ENSP00000436520
MGPLRESKKEHRVQHHDKEISRSRIPRLILRPHMPQQQHKVSPASESPFSEEESREFNPSSSGRSARTVSSNSFCSDDTGCPSSQSVSPVKTPSD

SEQ ID NO: 85961 - protein, 125 aa, Homo sapiens
  Payload ID: 17070
  Gene Symbol: SYBU
  Gene Name: syntabulin (syntaxin-interacting)
  ENSP ID: ENSP00000436797
MVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIM

SEQ ID NO: 85962 - protein, 47 aa, Homo sapiens
  Payload ID: 17070
  Gene Symbol: SYBU
  Gene Name: syntabulin (syntaxin-interacting)
  ENSP ID: ENSP00000436850
MFAMKVYGAYLLSSEADFSSSSSTGSISAPEVHMSTAGSKRSSSSRK

SEQ ID NO: 85963 - protein, 80 aa, Homo sapiens; identical to SEQ ID NO: 85950
  Payload ID: 17070
  Gene Symbol: SYBU
  Gene Name: syntabulin (syntaxin-interacting)
  ENSP ID: ENSP00000436908

SEQ ID NO: 85964 - protein, 538 aa, Homo sapiens
  Payload ID: 17071
  Gene Symbol: SNPH
  Gene Name: syntaphilin
  Uniprot ID: O15079
  ENSP ID: ENSP00000371291
MPGSGPSERMTWPGPALSAGPPTRPLSSAPGIPPIPPLTRTHSLMAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 85965 - protein, 494 aa, Homo sapiens
  Payload ID: 17071
  Gene Symbol: SNPH
  Gene Name: syntaphilin
  Uniprot ID: O15079
  ENSP ID: ENSP00000371297
MAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 85966 - protein, 538 aa, Homo sapiens; identical to SEQ ID NO: 85964
  Payload ID: 17071
  Gene Symbol: SNPH
  Gene Name: syntaphilin
  Uniprot ID: O15079
  ENSP ID: ENSP00000479696

SEQ ID NO: 85967 - protein, 220 aa, Homo sapiens
  Payload ID: 17072
  Gene Symbol: STX10
  Gene Name: syntaxin 10
  ENSP ID: ENSP00000242770
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQACWMPSPKRWTTPSPAWTGSSGSWPKYPT

SEQ ID NO: 85968 - protein, 200 aa, Homo sapiens
  Payload ID: 17072
  Gene Symbol: STX10
  Gene Name: syntaxin 10
  Uniprot ID: O60499
  ENSP ID: ENSP00000339350
MSLEDPFFVVRGEVQKAVNTARGLYQRWCELLQESAAVGREELDWTTNELRNGLRSIEWDLEDLEETIGIVEANPGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 85969 - protein, 73 aa, Homo sapiens
  Payload ID: 17072
  Gene Symbol: STX10
  Gene Name: syntaxin 10
  ENSP ID: ENSP00000415176
MSLEDPFFVVRGEVQKAVNTARGLYQRWCELLQESAAVGREELDWTTNELRNGLRSIEWDLEDLEETIVSAHV

SEQ ID NO: 85970 - protein, 228 aa, Homo sapiens
  Payload ID: 17072
  Gene Symbol: STX10
  Gene Name: syntaxin 10
  ENSP ID: ENSP00000464943
  MOD_RES (1)..(1): Any amino acid
XAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSVPGPQSHLPLCLIHVPTWK

SEQ ID NO: 85971 - protein, 58 aa, Homo sapiens
  Payload ID: 17072
  Gene Symbol: STX10
  Gene Name: syntaxin 10
  ENSP ID: ENSP00000464970
MREAVQEMKDHMVSPTAVAFLERNNREILAGKPAAQKSPSDLLDASAVSATSRYIEEQ

SEQ ID NO: 85972 - protein, 246 aa, Homo sapiens
  Payload ID: 17072
  Gene Symbol: STX10
  Gene Name: syntaxin 10
  ENSP ID: ENSP00000465398
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSGESPQGRGQSWWGQVVGGTLSP

SEQ ID NO: 85973 - protein, 113 aa, Homo sapiens
  Payload ID: 17072
  Gene Symbol: STX10
  Gene Name: syntaxin 10
  ENSP ID: ENSP00000465495
MSLEDPFFVVRGEVQKAVNTARGLYQRWCELLQESAAVGREELDWTTNELRNGLRSIEWDLEDLEETIDILGLYTRRQASCPEVTQRPAGCQRSLGHISLHRGAAGHTAADHG

SEQ ID NO: 85974 - protein, 201 aa, Homo sapiens
  Payload ID: 17072
  Gene Symbol: STX10
  Gene Name: syntaxin 10
  ENSP ID: ENSP00000466272
LQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSALPGRLVP

SEQ ID NO: 85975 - protein, 249 aa, Homo sapiens
  Payload ID: 17072
  Gene Symbol: STX10
  Gene Name: syntaxin 10
  Uniprot ID: O60499
  ENSP ID: ENSP00000466298
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 85976 - protein, 122 aa, Homo sapiens
  Payload ID: 17072
  Gene Symbol: STX10
  Gene Name: syntaxin 10
  ENSP ID: ENSP00000467479
MREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKL

SEQ ID NO: 85977 - protein, 97 aa, Homo sapiens
  Payload ID: 17072
  Gene Symbol: STX10
  Gene Name: syntaxin 10
  ENSP ID: ENSP00000467713
  MOD_RES (1)..(1): Any amino acid
XCCVPLQILAGKPAAQKSPSDLLDASAVSATSRYIEEQQATQQLIMDEQDQQLEMVSGSIQVLKHMSGRVGEELDEQGIMLDAFAQEMDHTQSRMDG

SEQ ID NO: 85978 - protein, 287 aa, Homo sapiens
  Payload ID: 17073
  Gene Symbol: STX11
  Gene Name: syntaxin 11
  Uniprot ID: O75558
  ENSP ID: ENSP00000356540
MKDRLAELLDLSKQYDQQFPDGDDEFDSPHEDIVFETDHILESLYRDIRDIQDENQLLVADVKRLGKQNARFLTSMRRLSSIKRDTNSIAKAIKARGEVIHCKLRAMKELSEAAEAQHGPHSAVARISRAQYNALTLTFQRAMHDYNQAEMKQRDNCKIRIQRQLEIMGKEVSGDQIEDMFEQGKWDVFSENLLADVKGARAALNEIESRHRELLRLESRIRDVHELFLQMAVLVEKQADTLNVIELNVQKTVDYTGQAKAQVRKAVQYEEKNPCRTLCCFCCPCLK

SEQ ID NO: 85979 - protein, 276 aa, Homo sapiens
  Payload ID: 17074
  Gene Symbol: STX12
  Gene Name: syntaxin 12
  Uniprot ID: Q86Y82
  ENSP ID: ENSP00000363054
MSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDEVAITEQDLELIKERETAIRQLEADILDVNQIFKDLAMMIHDQGDLIDSIEANVESSEVHVERATEQLQRAAYYQKKSRKKMCILVLVLSVIILILGLIIWLVYKTK

SEQ ID NO: 85980 - protein, 215 aa, Homo sapiens
  Payload ID: 17074
  Gene Symbol: STX12
  Gene Name: syntaxin 12
  ENSP ID: ENSP00000392577
MSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSSLLLDMKNVALQDFIDSRGLEPCHEEWNQMQSQEDEVAITEQDLELIKERETAIRQLE

SEQ ID NO: 85981 - protein, 204 aa, Homo sapiens
  Payload ID: 17075
  Gene Symbol: STX16
  Gene Name: syntaxin 16
  ENSP ID: ENSP00000312086
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDL

SEQ ID NO: 85982 - protein, 308 aa, Homo sapiens
  Payload ID: 17075
  Gene Symbol: STX16
  Gene Name: syntaxin 16
  Uniprot ID: O14662
  ENSP ID: ENSP00000348229
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 85983 - protein, 321 aa, Homo sapiens
  Payload ID: 17075
  Gene Symbol: STX16
  Gene Name: syntaxin 16
  Uniprot ID: O14662
  ENSP ID: ENSP00000350723
MATRRLTDAFLLLRNNSIQNRQLLAEQVSSHITSSPLHSRSIAALADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 85984 - protein, 272 aa, Homo sapiens
  Payload ID: 17075
  Gene Symbol: STX16
  Gene Name: syntaxin 16
  Uniprot ID: O14662
  ENSP ID: ENSP00000352634
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 85985 - protein, 272 aa, Homo sapiens; identical to SEQ ID NO: 85984
  Payload ID: 17075
  Gene Symbol: STX16
  Gene Name: syntaxin 16
  Uniprot ID: O14662
  ENSP ID: ENSP00000354445

SEQ ID NO: 85986 - protein, 307 aa, Homo sapiens
  Payload ID: 17075
  Gene Symbol: STX16
  Gene Name: syntaxin 16
  ENSP ID: ENSP00000355408
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQLFHRCQRAVQPCRAGPGPAPSRRGGCLGTWGLLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 85987 - protein, 304 aa, Homo sapiens
  Payload ID: 17075
  Gene Symbol: STX16
  Gene Name: syntaxin 16
  Uniprot ID: O14662
  ENSP ID: ENSP00000360173
MATRRLTDAFLLLRNNSIQNRQLLAEQLADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 85988 - protein, 325 aa, Homo sapiens
  Payload ID: 17075
  Gene Symbol: STX16
  Gene Name: syntaxin 16
  Uniprot ID: O14662
  ENSP ID: ENSP00000360183
MATRRLTDAFLLLRNNSIQNRQLLAEQVSSHITSSPLHSRSIAAELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 85989 - protein, 122 aa, Homo sapiens
  Payload ID: 17075
  Gene Symbol: STX16
  Gene Name: syntaxin 16
  ENSP ID: ENSP00000388348
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTS

SEQ ID NO: 85990 - protein, 219 aa, Homo sapiens
  Payload ID: 17075
  Gene Symbol: STX16
  Gene Name: syntaxin 16
  ENSP ID: ENSP00000401801
GISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGTVLDRIDYNVEQSCIKTEDGLKQLHKAEQYQKKNRKMLVILILFVIIIVLIVVLVGVKSR

SEQ ID NO: 85991 - protein, 120 aa, Homo sapiens
  Payload ID: 17075
  Gene Symbol: STX16
  Gene Name: syntaxin 16
  ENSP ID: ENSP00000416852
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELS

SEQ ID NO: 85992 - protein, 202 aa, Homo sapiens
  Payload ID: 17075
  Gene Symbol: STX16
  Gene Name: syntaxin 16
  ENSP ID: ENSP00000432414
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRRTS

SEQ ID NO: 85993 - protein, 79 aa, Homo sapiens
  Payload ID: 17075
  Gene Symbol: STX16
  Gene Name: syntaxin 16
  ENSP ID: ENSP00000432823
MALVSGISLDPEAAIGVTKRPPPKWVDGVDEIQYDVGRIKQKMKELASLHDKHLNRPTLDDSSEEEHAIEITTQEITQA

SEQ ID NO: 85994 - protein, 115 aa, Homo sapiens
  Payload ID: 17075
  Gene Symbol: STX16
  Gene Name: syntaxin 16
  Uniprot ID: O14662
  ENSP ID: ENSP00000434369
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQA

SEQ ID NO: 85995 - protein, 46 aa, Homo sapiens
  Payload ID: 17075
  Gene Symbol: STX16
  Gene Name: syntaxin 16
  ENSP ID: ENSP00000435118
MALVSGISLDPEAAIGVTKRPPPKWVDGVDEVSSIFSMMLAGLSRR

SEQ ID NO: 85996 - protein, 126 aa, Homo sapiens
  Payload ID: 17075
  Gene Symbol: STX16
  Gene Name: syntaxin 16
  ENSP ID: ENSP00000436667
  MOD_RES (1)..(1): Any amino acid
XDAFLLLRNNSIQNRQLLAEQVSSHITSSPLHSRSIAAELDELADDRMALVSGISLDPEAAIGVTKRPPPKWVDGVDEIQYDVGRIKQKMKELASLHDKHLNRPTLDDSSEEEHAIEITTQEITQA

SEQ ID NO: 85997 - protein, 79 aa, Homo sapiens; identical to SEQ ID NO: 85993
  Payload ID: 17075
  Gene Symbol: STX16
  Gene Name: syntaxin 16
  ENSP ID: ENSP00000437209

SEQ ID NO: 85998 - protein, 302 aa, Homo sapiens
  Payload ID: 17076
  Gene Symbol: STX17
  Gene Name: syntaxin 17
  Uniprot ID: P56962
  ENSP ID: ENSP00000259400
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGAFHTTEAEASSQSLTQIYALPEIPQDQNAAESWETLEADLIELSQLVTDFSLLVNSQQEKIDSIADHVNSAAVNVEEGTKNLGKAAKYKLAALPVAGALIGGMVGGPIGLLAGFKVAGIAAALGGGVLGFTGGKLIQRKKQKMMEKLTSSCPDLPSQTDKKCS

SEQ ID NO: 85999 - protein, 302 aa, Homo sapiens; identical to SEQ ID NO: 85998
  Payload ID: 17076
  Gene Symbol: STX17
  Gene Name: syntaxin 17
  Uniprot ID: P56962
  ENSP ID: ENSP00000433484

SEQ ID NO: 86000 - protein, 41 aa, Homo sapiens
  Payload ID: 17076
  Gene Symbol: STX17
  Gene Name: syntaxin 17
  ENSP ID: ENSP00000433694
MSEDEEKVKLRRLEPAIQKFIKIVIPTDLERLRKHQINIEK

SEQ ID NO: 86001 - protein, 68 aa, Homo sapiens
  Payload ID: 17076
  Gene Symbol: STX17
  Gene Name: syntaxin 17
  ENSP ID: ENSP00000433701
MSEDEEKVKLRRLEPAIQKFIKIVIPTDLERLRKHQINIEKYQRCRIWDKLHEEHINAGRTVQFRNYI

SEQ ID NO: 86002 - protein, 45 aa, Homo sapiens
  Payload ID: 17076
  Gene Symbol: STX17
  Gene Name: syntaxin 17
  ENSP ID: ENSP00000434323
MSEDEEKVKLRRLEPAIQKFIKIVIPTDLERLRKHQINIEKVYIH

SEQ ID NO: 86003 - protein, 41 aa, Homo sapiens; identical to SEQ ID NO: 86000
  Payload ID: 17076
  Gene Symbol: STX17
  Gene Name: syntaxin 17
  ENSP ID: ENSP00000434547

SEQ ID NO: 86004 - protein, 302 aa, Homo sapiens; identical to SEQ ID NO: 85998
  Payload ID: 17076
  Gene Symbol: STX17
  Gene Name: syntaxin 17
  Uniprot ID: P56962
  ENSP ID: ENSP00000435981

SEQ ID NO: 86005 - protein, 141 aa, Homo sapiens
  Payload ID: 17076
  Gene Symbol: STX17
  Gene Name: syntaxin 17
  ENSP ID: ENSP00000436666
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGLN

SEQ ID NO: 86006 - protein, 335 aa, Homo sapiens
  Payload ID: 17077
  Gene Symbol: STX18
  Gene Name: syntaxin 18
  Uniprot ID: Q9P2W9
  ENSP ID: ENSP00000305810
MAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREAIKNNAGFRVWILFFLVMCSFSLLFLDWYDS

SEQ ID NO: 86007 - protein, 169 aa, Homo sapiens
  Payload ID: 17077
  Gene Symbol: STX18
  Gene Name: syntaxin 18
  ENSP ID: ENSP00000422376
MSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLF

SEQ ID NO: 86008 - protein, 308 aa, Homo sapiens
  Payload ID: 17077
  Gene Symbol: STX18
  Gene Name: syntaxin 18
  ENSP ID: ENSP00000426648
MAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREVPHL

SEQ ID NO: 86009 - protein, 294 aa, Homo sapiens
  Payload ID: 17078
  Gene Symbol: STX19
  Gene Name: syntaxin 19
  Uniprot ID: Q8N4C7
  ENSP ID: ENSP00000320679
MKDRLQELKQRTKEIELSRDSHVSTTETEEQGVFLQQAVIYEREPVAERHLHEIQKLQESINNLADNVQKFGQQQKSLVASMRRFSLLKRESTITKEIKIQAEYINRSLNDLVKEVKKSEVENGPSSVVTRILKSQHAAMFRHFQQIMFIYNDTIAAKQEKCKTFILRQLEVAGKEMSEEDVNDMLHQGKWEVFNESLLTEINITKAQLSEIEQRHKELVNLENQIKDLRDLFIQISLLVEEQGESINNIEMTVNSTKEYVNNTKEKFGLAVKYKKRNPCRVLCCWCCPCCSSK

SEQ ID NO: 86010 - protein, 288 aa, Homo sapiens
  Payload ID: 17079
  Gene Symbol: STX1A
  Gene Name: syntaxin 1A (brain)
  Uniprot ID: Q16623
  ENSP ID: ENSP00000222812
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQGEMIDRIEYNVEHAVDYVERAVSDTKKAVKYQSKARRKKIMIIICCVILGIVIASTVGGIFA

SEQ ID NO: 86011 - protein, 280 aa, Homo sapiens
  Payload ID: 17079
  Gene Symbol: STX1A
  Gene Name: syntaxin 1A (brain)
  ENSP ID: ENSP00000378583
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQVSAGPPCPPLQPTPAPRAALTSPFLPDTLPCRGGTKFSASGCFPEVLPRAPTQP

SEQ ID NO: 86012 - protein, 260 aa, Homo sapiens
  Payload ID: 17079
  Gene Symbol: STX1A
  Gene Name: syntaxin 1A (brain)
  ENSP ID: ENSP00000378584
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQPQGAFLKSCPEPQPNPEEGALWSSGAPGPAGRDD

SEQ ID NO: 86013 - protein, 251 aa, Homo sapiens
  Payload ID: 17079
  Gene Symbol: STX1A
  Gene Name: syntaxin 1A (brain)
  Uniprot ID: Q16623
  ENSP ID: ENSP00000378585
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQTMWRGPCLTPRRPSSTRARRAGRKS

SEQ ID NO: 86014 - protein, 288 aa, Homo sapiens
  Payload ID: 17080
  Gene Symbol: STX1B
  Gene Name: syntaxin 1B
  Uniprot ID: P61266
  ENSP ID: ENSP00000215095
MKDRTQELRSAKDSDDEEEVVHVDRDHFMDEFFEQVEEIRGCIEKLSEDVEQVKKQHSAILAAPNPDEKTKQELEDLTADIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRKKIMIIICCVVLGVVLASSIGGTLGL

SEQ ID NO: 86015 - protein, 277 aa, Homo sapiens
  Payload ID: 17080
  Gene Symbol: STX1B
  Gene Name: syntaxin 1B
  Uniprot ID: P61266
  ENSP ID: ENSP00000455899
MKDRTQELRSAKDSDDEEEVVHVDRDHFMDEFFEQVEEIRGCIEKLSEDVEQVKKQHSAILAAPNPDEKTKQELEDLTADIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRVSGAGGLGVGGGAQG

SEQ ID NO: 86016 - protein, 204 aa, Homo sapiens
  Payload ID: 17080
  Gene Symbol: STX1B
  Gene Name: syntaxin 1B
  ENSP ID: ENSP00000457067
ANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRKKIMIIICCVVLGVVLASSIGGTLGL

SEQ ID NO: 86017 - protein, 287 aa, Homo sapiens
  Payload ID: 17081
  Gene Symbol: STX2
  Gene Name: syntaxin 2
  Uniprot ID: P32856
  ENSP ID: ENSP00000261653
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKLMFIIICVIVLLVILGIILATTLS

SEQ ID NO: 86018 - protein, 112 aa, Homo sapiens
  Payload ID: 17081
  Gene Symbol: STX2
  Gene Name: syntaxin 2
  ENSP ID: ENSP00000342554
  MOD_RES (1)..(1): Any amino acid
XGDTVVVVEKDHFMDDFFHQVEEIRNSIDKITQYVEEVKKNHSIILSAPNPEGKIKEELEDLNKEIKKTANKIRAKLKGFRCVQKQREATTSRPPSSTVLHELPPAPAPRLF

SEQ ID NO: 86019 - protein, 288 aa, Homo sapiens
  Payload ID: 17081
  Gene Symbol: STX2
  Gene Name: syntaxin 2
  Uniprot ID: P32856
  ENSP ID: ENSP00000376178
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKKWIIIAVSVVLVAIIALIIGLSVGK

SEQ ID NO: 86020 - protein, 258 aa, Homo sapiens
  Payload ID: 17082
  Gene Symbol: STX3
  Gene Name: syntaxin 3
  ENSP ID: ENSP00000300150
MDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 86021 - protein, 289 aa, Homo sapiens
  Payload ID: 17082
  Gene Symbol: STX3
  Gene Name: syntaxin 3
  Uniprot ID: Q13277
  ENSP ID: ENSP00000338562
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 86022 - protein, 204 aa, Homo sapiens
  Payload ID: 17082
  Gene Symbol: STX3
  Gene Name: syntaxin 3
  ENSP ID: ENSP00000431386
ISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQKLIIIIVLVVVLLGILALIIGLSVGLN

SEQ ID NO: 86023 - protein, 277 aa, Homo sapiens
  Payload ID: 17082
  Gene Symbol: STX3
  Gene Name: syntaxin 3
  Uniprot ID: Q13277
  ENSP ID: ENSP00000433248
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLISLQTGVATLVFR

SEQ ID NO: 86024 - protein, 76 aa, Homo sapiens
  Payload ID: 17082
  Gene Symbol: STX3
  Gene Name: syntaxin 3
  ENSP ID: ENSP00000434836
MFMDIAMLVENQGEMLDNIELNVMHTVDHVEKARDETKKAVKYQSQARKKLIIIIVLVVVLLGILALIIGLSVGLN

SEQ ID NO: 86025 - protein, 43 aa, Homo sapiens
  Payload ID: 17082
  Gene Symbol: STX3
  Gene Name: syntaxin 3
  ENSP ID: ENSP00000436200
MKDRLEQLKAKQLTQDDDTDAVEIAIDNTAFMDEFFSEKPRMT

SEQ ID NO: 86026 - protein, 287 aa, Homo sapiens
  Payload ID: 17082
  Gene Symbol: STX3
  Gene Name: syntaxin 3
  ENSP ID: ENSP00000487790
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGSMIDRIENNMDQSVGFVERAVADTKKAVKYQSEARRKKIMIMICCIILAIILASTIGSIFA

SEQ ID NO: 86027 - protein, 297 aa, Homo sapiens
  Payload ID: 17083
  Gene Symbol: STX4
  Gene Name: syntaxin 4
  Uniprot ID: Q12846
  ENSP ID: ENSP00000317714
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 86028 - protein, 295 aa, Homo sapiens
  Payload ID: 17083
  Gene Symbol: STX4
  Gene Name: syntaxin 4
  Uniprot ID: Q12846
  ENSP ID: ENSP00000378447
MGMTARTKRTRSGSRWWCTRARHGWGARTRSSSTSPLGHPPQVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 86029 - protein, 175 aa, Homo sapiens
  Payload ID: 17083
  Gene Symbol: STX4
  Gene Name: syntaxin 4
  ENSP ID: ENSP00000390788
MLSRQSAHALDPKAIKARFPLEDATVPVTVASSRVQASPLPLGAQQLPTPPSQPRARKRRDHGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMR

SEQ ID NO: 86030 - protein, 64 aa, Homo sapiens
  Payload ID: 17083
  Gene Symbol: STX4
  Gene Name: syntaxin 4
  ENSP ID: ENSP00000454419
MRDRTHELRQGDDSSDEEDKERVALVVHPGTARLGSPDEEFFHKPSRSPSPGPDNSADYCQTGE

SEQ ID NO: 86031 - protein, 64 aa, Homo sapiens; identical to SEQ ID NO: 86030
  Payload ID: 17083
  Gene Symbol: STX4
  Gene Name: syntaxin 4
  ENSP ID: ENSP00000454841

SEQ ID NO: 86032 - protein, 115 aa, Homo sapiens
  Payload ID: 17083
  Gene Symbol: STX4
  Gene Name: syntaxin 4
  ENSP ID: ENSP00000480544
  MOD_RES (1)..(1): Any amino acid
XMRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKGELLGPQTDPSL

SEQ ID NO: 86033 - protein, 355 aa, Homo sapiens
  Payload ID: 17084
  Gene Symbol: STX5
  Gene Name: syntaxin 5
  Uniprot ID: Q13190
  ENSP ID: ENSP00000294179
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 86034 - protein, 321 aa, Homo sapiens
  Payload ID: 17084
  Gene Symbol: STX5
  Gene Name: syntaxin 5
  Uniprot ID: Q13190
  ENSP ID: ENSP00000367129
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQSVLLFPLLPALSPGSTRTC

SEQ ID NO: 86035 - protein, 301 aa, Homo sapiens
  Payload ID: 17084
  Gene Symbol: STX5
  Gene Name: syntaxin 5
  Uniprot ID: Q13190
  ENSP ID: ENSP00000378182
MSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 86036 - protein, 158 aa, Homo sapiens
  Payload ID: 17084
  Gene Symbol: STX5
  Gene Name: syntaxin 5
  ENSP ID: ENSP00000414289
  MOD_RES (1)..(1): Any amino acid
XNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQR

SEQ ID NO: 86037 - protein, 250 aa, Homo sapiens
  Payload ID: 17084
  Gene Symbol: STX5
  Gene Name: syntaxin 5
  ENSP ID: ENSP00000432748
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGKSQAVVLWFWGQSPMPPRMSPST

SEQ ID NO: 86038 - protein, 81 aa, Homo sapiens
  Payload ID: 17084
  Gene Symbol: STX5
  Gene Name: syntaxin 5
  ENSP ID: ENSP00000434107
MIPRKRYGSKNTDQGVYLGLSKTQVLSPATAGSSSSDIAPLPPPVTLVPPPPDTMSCRDRTQEFLSACKSLQTRQAHWERP

SEQ ID NO: 86039 - protein, 67 aa, Homo sapiens
  Payload ID: 17084
  Gene Symbol: STX5
  Gene Name: syntaxin 5
  ENSP ID: ENSP00000435973
  MOD_RES (1)..(1): Any amino acid
XVFGRVSAASVLGEEAVTAGEIGSGGGGRRQRGVTLVPPPPDTMSCRDRTQEFLSACKSLQTRQAGV

SEQ ID NO: 86040 - protein, 78 aa, Homo sapiens
  Payload ID: 17084
  Gene Symbol: STX5
  Gene Name: syntaxin 5
  ENSP ID: ENSP00000436495
MIPRKRYGSKNTDQGVYLGLSKTQVLSPATAGSSSSDIAPLPPPVTLVPPPPDTMSCRDRTQEFLSACKSLQTRQAGV

SEQ ID NO: 86041 - protein, 255 aa, Homo sapiens
  Payload ID: 17085
  Gene Symbol: STX6
  Gene Name: syntaxin 6
  Uniprot ID: O43752
  ENSP ID: ENSP00000258301
MSMEDPFFVVKGEVQKAVNTAQGLFQRWTELLQDPSTATREEIDWTTNELRNNLRSIEWDLEDLDETISIVEANPRKFNLDATELSIRKAFITSTRQVVRDMKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVMLEDFSHELESTQSRLDNVMKKLAKVSHMTSDRRQWCAIAILFAVLLVVLILFLVL

SEQ ID NO: 86042 - protein, 154 aa, Homo sapiens
  Payload ID: 17085
  Gene Symbol: STX6
  Gene Name: syntaxin 6
  Uniprot ID: O43752
  ENSP ID: ENSP00000440188
MKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVMLEDFSHELESTQSRLDNVMKKLAKVSHMTSDRRQWCAIAILFAVLLVVLILFLVL

SEQ ID NO: 86043 - protein, 239 aa, Homo sapiens
  Payload ID: 17086
  Gene Symbol: STX7
  Gene Name: syntaxin 7
  Uniprot ID: O15400
  ENSP ID: ENSP00000356914
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQKKDSCMLM

SEQ ID NO: 86044 - protein, 261 aa, Homo sapiens
  Payload ID: 17086
  Gene Symbol: STX7
  Gene Name: syntaxin 7
  Uniprot ID: O15400
  ENSP ID: ENSP00000356918
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 86045 - protein, 236 aa, Homo sapiens
  Payload ID: 17087
  Gene Symbol: STX8
  Gene Name: syntaxin 8
  Uniprot ID: Q9UNK0
  ENSP ID: ENSP00000305255
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 86046 - protein, 112 aa, Homo sapiens
  Payload ID: 17087
  Gene Symbol: STX8
  Gene Name: syntaxin 8
  ENSP ID: ENSP00000460073
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLM

SEQ ID NO: 86047 - protein, 44 aa, Homo sapiens
  Payload ID: 17087
  Gene Symbol: STX8
  Gene Name: syntaxin 8
  ENSP ID: ENSP00000460355
MAPDPWFSTYDSTCQIAQEIAEKIQQRNQYERKGEKAPKVQPDE

SEQ ID NO: 86048 - protein, 125 aa, Homo sapiens
  Payload ID: 17087
  Gene Symbol: STX8
  Gene Name: syntaxin 8
  ENSP ID: ENSP00000467749
MSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 86049 - protein, 51 aa, Homo sapiens
  Payload ID: 17087
  Gene Symbol: STX8
  Gene Name: syntaxin 8
  ENSP ID: ENSP00000468093
MAPDPWFSTYDSTCQIAQEIAEKIQQRNQYERKGEKAPKNRTQALMPFPLS

SEQ ID NO: 86050 - protein, 594 aa, Homo sapiens
  Payload ID: 17088
  Gene Symbol: STXBP1
  Gene Name: syntaxin binding protein 1
  Uniprot ID: P61764
  ENSP ID: ENSP00000362396
MAPIGLKAVVGEKIMHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVSARYGHWHKNKAPGEYRSGPRLIIFILGGVSLNEMRCAYEVTQANGKWEVLIGSTHILTPQKLLDTLKKLNKTDEEISS

SEQ ID NO: 86051 - protein, 603 aa, Homo sapiens [sequence omitted]

SEQ ID NO: 86052 - protein, 75 aa, Homo sapiens
  Payload ID: 17088
  Gene Symbol: STXBP1
  Gene Name: syntaxin binding protein 1
  ENSP ID: ENSP00000485361
  MOD_RES (1)..(1): Any amino acid
XKSRAAKVIKTLTEINIAFLPYESQVYSLDSADSFQSFYSPHKAQMKNPILERLAEQIATLCATLKEYPAVRYRG

SEQ ID NO: 86053 - protein, 119 aa, Homo sapiens
  Payload ID: 17088
  Gene Symbol: STXBP1
  Gene Name: syntaxin binding protein 1
  ENSP ID: ENSP00000485397
IMEDTIEDKLDTKHYPYISTRSSASFSTTAVSARYGHWHKNKAPGEYRSGPRLIIFILGGVSLNEMRCAYEVTQANGKWEVLIGSTHILTPTKFLMDLRHPDFRESSRVSFEDQAPTME

SEQ ID NO: 86054 - protein, 102 aa, Homo sapiens
  Payload ID: 17088
  Gene Symbol: STXBP1
  Gene Name: syntaxin binding protein 1
  ENSP ID: ENSP00000485680
MHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFN

SEQ ID NO: 86055 - protein, 100 aa, Homo sapiens
  Payload ID: 17088
  Gene Symbol: STXBP1
  Gene Name: syntaxin binding protein 1
  ENSP ID: ENSP00000485895
MRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAF

SEQ ID NO: 86056 - protein, 147 aa, Homo sapiens
  Payload ID: 17088
  Gene Symbol: STXBP1
  Gene Name: syntaxin binding protein 1
  ENSP ID: ENSP00000486814
MHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHK

SEQ ID NO: 86057 - protein, 149 aa, Homo sapiens
  Payload ID: 17088
  Gene Symbol: STXBP1
  Gene Name: syntaxin binding protein 1
  ENSP ID: ENSP00000486944
MHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQ

SEQ ID NO: 86058 - protein, 143 aa, Homo sapiens
  Payload ID: 17088
  Gene Symbol: STXBP1
  Gene Name: syntaxin binding protein 1
  ENSP ID: ENSP00000487211
MHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFY

SEQ ID NO: 86059 - protein, 593 aa, Homo sapiens
  Payload ID: 17089
  Gene Symbol: STXBP2
  Gene Name: syntaxin binding protein 2
  Uniprot ID: Q15833
  ENSP ID: ENSP00000221283
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 86060 - protein, 590 aa, Homo sapiens
  Payload ID: 17089
  Gene Symbol: STXBP2
  Gene Name: syntaxin binding protein 2
  Uniprot ID: Q15833
  ENSP ID: ENSP00000409471
MAPSGLKAVVGEKILSGVIRSVKKDGEWKVLIMDHPSMRILSSCCKMSDILAEGITIVEDINKRREPIPSLEAIYLLSPTEKALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 86061 - protein, 604 aa, Homo sapiens
  Payload ID: 17089
  Gene Symbol: STXBP2
  Gene Name: syntaxin binding protein 2
  Uniprot ID: Q15833
  ENSP ID: ENSP00000413606
MAPSGLKAVVGEKILSGVIRSVKKDGEWKVLIMDHPSMRILSSCCKMSDILAEGITIVEDINKRREPIPSLEAIYLLSPTEKAQAQRVIHLPQSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 86062 - protein, 111 aa, Homo sapiens
  Payload ID: 17089
  Gene Symbol: STXBP2
  Gene Name: syntaxin binding protein 2
  ENSP ID: ENSP00000470313
MDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQ

SEQ ID NO: 86063 - protein, 169 aa, Homo sapiens
  Payload ID: 17089
  Gene Symbol: STXBP2
  Gene Name: syntaxin binding protein 2
  ENSP ID: ENSP00000471161
MAPSGLKAVVGEKILSGVIRSVKKDGEWKVLIMDHPSMRILSSCCKMSDILAEGITTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGE

SEQ ID NO: 86064 - protein, 408 aa, Homo sapiens
  Payload ID: 17089
  Gene Symbol: STXBP2
  Gene Name: syntaxin binding protein 2
  ENSP ID: ENSP00000471327
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKDLAMGSDAEGEKIKDSMKLIVPVLLDAAVPAYDKIRVLLLYILLRNATPLDPGTLLHWLGDSSTEV

SEQ ID NO: 86065 - protein, 171 aa, Homo sapiens
  Payload ID: 17089
  Gene Symbol: STXBP2
  Gene Name: syntaxin binding protein 2
  ENSP ID: ENSP00000471585
GVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQGPRGHSPVGPRRPGQAERLQGRHSQSGRGPRENPLPAADNGPGS

SEQ ID NO: 86066 - protein, 220 aa, Homo sapiens
  Payload ID: 17089
  Gene Symbol: STXBP2
  Gene Name: syntaxin binding protein 2
  ENSP ID: ENSP00000471737
  MOD_RES (1)..(1): Any amino acid
XLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVRLLTHPHPDPLPG

SEQ ID NO: 86067 - protein, 149 aa, Homo sapiens
  Payload ID: 17089
  Gene Symbol: STXBP2
  Gene Name: syntaxin binding protein 2
  ENSP ID: ENSP00000473040
  MOD_RES (1)..(1): Any amino acid
XSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGPHQAQPLCDQPPSPQSPCCPPCPACRARGPPAGWSRENAWSPPISCPAGPRSSRM

SEQ ID NO: 86068 - protein, 128 aa, Homo sapiens
  Payload ID: 17089
  Gene Symbol: STXBP2
  Gene Name: syntaxin binding protein 2
  ENSP ID: ENSP00000473406
MEPTYQLSRWTPVIKDVMEDAVEDRLDRNLWPFVSDPAPTASSQAAVSARFGHWHKNKAGIEARAGPRLIVYVMGGVAMSEMRAAYEVTRATEGKWEVLIGSSHILTPTRFLDDLKALDKKLEDIALP

SEQ ID NO: 86069 - protein, 395 aa, Homo sapiens [sequence omitted]

SEQ ID NO: 86070 - protein, 579 aa, Homo sapiens
  Payload ID: 17089
  Gene Symbol: STXBP2
  Gene Name: syntaxin binding protein 2
  ENSP ID: ENSP00000480468
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGIEARAGPRLIVYVMGGVAMSEMRAAYEVTRATEGSGRCSLAPHTSSPRPASWMT

SEQ ID NO: 86071 - protein, 592 aa, Homo sapiens
  Payload ID: 17090
  Gene Symbol: STXBP3
  Gene Name: syntaxin binding protein 3
  Uniprot ID: O00186
  ENSP ID: ENSP00000359025
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKEKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIENESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRCAYEVSQAHKSCEVIIGSTHVLTPKKLLDDIKMLNKPKDKVSLIKDE

SEQ ID NO: 86072 - protein, 553 aa, Homo sapiens
  Payload ID: 17091
  Gene Symbol: STXBP4
  Gene Name: syntaxin binding protein 4
  Uniprot ID: Q6ZWJ1
  ENSP ID: ENSP00000365530
MNKNTSTVVSPSLLEKDPAFQMITIAKETGLGLKVLGGINRNEGPLVYIQEIIPGGDCYKDGRLKPGDQLVSVNKESMIGVSFEEAKSIITGAKLRLESAWEIAFIRQKSDNIQPENLSCTSLIEASGEYGPQASTLSLFSSPPEILIPKTSSTPKTNNDILSSCEIKTGYNKTVQIPITSENSTVGLSNTDVASAWTENYGLQEKISLNPSVRFKAEKLEMALNYLGIQPTKEQHQALRQQVQADSKGTVSFGDFVQVARNLFCLQLDEVNVGAHEISNILDSQLLPCDSSEADEMERLKCERDDALKEVNTLKEKLLESDKQRKQLTEELQNVKQEAKAVVEETRALRSRIHLAEAAQRQAHGMEMDYEEVIRLLEAKITELKAQLADYSDQNKESVQDLKKRIMVLDCQLRKSEMARKTFEASTEKLLHFVEAIQEVFSDNSTPLSNLSERRAVLASQTSLTPLGRNGRSIPATLALESKELVKSVRALLDMDCLPYGWEEAYTADGIKYFINHVTQTTSWIHPVMSVLNLSRSEENEEDCSRELPNQKS

SEQ ID NO: 86073 - protein, 245 aa, Homo sapiens
  Payload ID: 17091
  Gene Symbol: STXBP4
  Gene Name: syntaxin binding protein 4
  Uniprot ID: Q6ZWJ1
  ENSP ID: ENSP00000381427
MIGVSFEEAKSIITGAKLSTRLESAWEIAFIRQKSDNIQPENLSCTSLIEASGEYGPQASTLSLFSSPPEILIPKTSSTPKTNNDILSSCEIKTGYNKTVQIPITSENSTVGLSNTDVASAWTENYGLQEKISLNPSVRFKAEKLEMALNYLGIQPTKEQHQALRQQVQADSKGTVSFGDFVQVARNLFCLQLDEVNVGAHEISNILDSQLLPCDSSEADEMERLKCERDDALKEVNTLKWPGQN

SEQ ID NO: 86074 - protein, 320 aa, Homo sapiens
  Payload ID: 17091
  Gene Symbol: STXBP4
  Gene Name: syntaxin binding protein 4
  ENSP ID: ENSP00000385944
MNKNTSTVVSPSLLEKDPAFQMITIAKETGLGLKVLGGINRNEGPLVYIQEIIPGGDCYKDGRLKPGDQLVSVNKESMIGVSFEEAKSIITGAKLRLESAWEIAFIRQKSDNIQPENLSCTSLIEASGEYGPQASTLSLFSSPPEILIPKTSSTPKTNNDILSSCEIKTGYNKTVQIPITSENSTVGLSNTDVASAWTENYGLQEKISLNPSVRFKAEKLEMALNYLGIQPTKEQHQALRQQVQADSKGTVSFGDFVQVARNLFCLQLDEVNVGAHEISNILDSQLLPCDSSEADEMERLKCERDDALKEVNTLKWPGQN

SEQ ID NO: 86075 - protein, 531 aa, Homo sapiens
  Payload ID: 17091
  Gene Symbol: STXBP4
  Gene Name: syntaxin binding protein 4
  ENSP ID: ENSP00000391087
MNKNTSTVVSPSLLEKDPAFQMITIAKETGLGLKVLGGINRNEGPLVYIQEIIPGGDCYKDGRLKPGDQLVSVNKESMIGVSFEEAKSIITGAKLRLESAWEIAFIRQKSDNIQPENLSCTSLIEASGEYGPQASTLSLFSSPPEILIPKTSSTPKTNNDILSSCEIKTGYNKTVQIPITSENSTVGLSNTDVASAWTENYGLQEKISLNPSVRFKAEKLEMALNYLGIQPTKEQHQALRQQVQADSKGTVSFGDFVQVARNLFCLQLDEVNVGAHEISNILDSQLLPCDSSEADEMERLKCERDDALKEVNTLKEAKAVVEETRALRSRIHLAEAAQRQAHGMEMDYEEVIRLLEAKITELKAQLADYSDQNKESVQDLKKRIMVLDCQLRKSEMARKTFEASTEKLLHFVEAIQEVFSDNSTPLSNLSERRAVLASQTSLTPLGRNGRSIPATLALESKELVKSVRALLDMDCLPYGWEEAYTADGIKYFINHVTQTTSWIHPVMSVLNLSRSEENEEDCSRELPNQKS

SEQ ID NO: 86076 - protein, 81 aa, Homo sapiens
  Payload ID: 17091
  Gene Symbol: STXBP4
  Gene Name: syntaxin binding protein 4
  ENSP ID: ENSP00000468799
NNDILSSCEIKTGYNKTVQIPITSENSTVGLSNTGSKLSWYSAHKGTTPSPETASTSRLKRDSVFWRFCPGCQKLVLLAVG

SEQ ID NO: 86077 - protein, 1151 aa, Homo sapiens
  Payload ID: 17092
  Gene Symbol: STXBP5
  Gene Name: syntaxin binding protein 5 (tomosyn)
  Uniprot ID: Q5T5C0
  ENSP ID: ENSP00000321826
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPINGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSGSSSPHNSDDEQKMNNFIEKVKTKSRKFSKMVANDIAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 86078 - protein, 174 aa, Homo sapiens
  Payload ID: 17092
  Gene Symbol: STXBP5
  Gene Name: syntaxin binding protein 5 (tomosyn)
  ENSP ID: ENSP00000356445
  MOD_RES (1)..(1): Any amino acid
XKAVLLNLGTIELYGSNDPYRREPRSPRKSRQPSGAGLCDISEGTVVPEDRCKSPTSGSSSPHNSDDEQKMNNFIEKAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPS

SEQ ID NO: 86079 - protein, 1098 aa, Homo sapiens
  Payload ID: 17092
  Gene Symbol: STXBP5
  Gene Name: syntaxin binding protein 5 (tomosyn)
  Uniprot ID: Q5T5C0
  ENSP ID: ENSP00000356450
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPINGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 86080 - protein, 1115 aa, Homo sapiens
  Payload ID: 17092
  Gene Symbol: STXBP5
  Gene Name: syntaxin binding protein 5 (tomosyn)
  Uniprot ID: Q5T5C0
  ENSP ID: ENSP00000356451
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPINGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 86081 - protein, 263 aa, Homo sapiens
  Payload ID: 17092
  Gene Symbol: STXBP5
  Gene Name: syntaxin binding protein 5 (tomosyn)
  ENSP ID: ENSP00000376112
IELYGSNDPYRREPRSPRKSRQPSGGVLIVTSCMCGLSSLYSESMKKLRSSFLTGLCDISEGTVVPEDRCKSPTSAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNI

SEQ ID NO: 86082 - protein, 308 aa, Homo sapiens
  Payload ID: 17092
  Gene Symbol: STXBP5
  Gene Name: syntaxin binding protein 5 (tomosyn)
  ENSP ID: ENSP00000441479
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGVC

SEQ ID NO: 86083 - protein, 1186 aa, Homo sapiens
  Payload ID: 17093
  Gene Symbol: STXBP5L
  Gene Name: syntaxin binding protein 5-like
  Uniprot ID: Q9Y2K9
  ENSP ID: ENSP00000273666
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIADNFCMRGLSNFYPDLTKRIRTSYQSLTELNDSPVPLELERCKSPTSDHVNGHCTSPTSQSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMSLPSLRPMLDVNYLPLTDMRIARTFCFTNEGQALYLVSPTEIQRLTYSQEMCDNLQDMLGDLFTPIETPEAQNRGFLKGLFGGSGQTFDREELFGEASAGKASRSLAQHIPGPGSIEGMKGAAGGVMGELTRARIALDERGQRLGELEEKTAGMMTSAEAFSKHAHELMLKYKDKKWYQF

SEQ ID NO: 86084 - protein, 127 aa, Homo sapiens
  Payload ID: 17093
  Gene Symbol: STXBP5L
  Gene Name: syntaxin binding protein 5-like
  ENSP ID: ENSP00000419404
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALV

SEQ ID NO: 86085 - protein, 1002 aa, Homo sapiens
  Payload ID: 17093
  Gene Symbol: STXBP5L
  Gene Name: syntaxin binding protein 5-like
  ENSP ID: ENSP00000419627
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIAGLTELNDSPVPLELERCKSPTSDHVNGHCTSPTSQSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMRYLPSYKLSGNHNNTSKVQS

SEQ ID NO: 86086 - protein, 1162 aa, Homo sapiens
  Payload ID: 17093
  Gene Symbol: STXBP5L
  Gene Name: syntaxin binding protein 5-like
  ENSP ID: ENSP00000420019
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIAGLTELNDSPVPLELERCKSPTSDHVNGHCTSPTSQSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMSLPSLRPMLDVNYLPLTDMRIARTFCFTNEGQALYLVSPTEIQRLTYSQEMCDNLQDMLGDLFTPIETPEAQNRGFLKGLFGGSGQTFDREELFGEASAGKASRSLAQHIPGPGSIEGMKGAAGGVMGELTRARIALDERGQRLGELEEKTAGMMTSAEAFSKHAHELMLKYKDKKWYQF

SEQ ID NO: 86087 - protein, 1129 aa, Homo sapiens
  Payload ID: 17093
  Gene Symbol: STXBP5L
  Gene Name: syntaxin binding protein 5-like
  ENSP ID: ENSP00000420167
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIADNFCMRGLSNFYPDLTKRIRTSYQSLTELNDSPVPLELERCKSPTSENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMSLPSLRPMLDVNYLPLTDMRIARTFCFTNEGQALYLVSPTEIQRLTYSQEMCDNLQDMLGDLFTPIETPEAQNRGFLKGLFGGSGQTFDREELFGEASAGKASRSLAQHIPGPGSIEGMKGAAGGVMGELTRARIALDERGQRLGELEEKTAGMMTSAEAFSKHAHELMLKYKDKKWYQF

SEQ ID NO: 86088 - protein, 1000 aa, Homo sapiens
  Payload ID: 17093
  Gene Symbol: STXBP5L
  Gene Name: syntaxin binding protein 5-like
  ENSP ID: ENSP00000420287
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIADNFCMRGLSNFYPDLTKRIRTSYQSLTELNDSPVPLELERCKSPTSGLATRTPESALGFYRNEISAMRQRNQVYHLPENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMRYLPSYKLSGNHNNTSKVQS

SEQ ID NO: 86089 - protein, 74 aa, Homo sapiens
  Payload ID: 17093
  Gene Symbol: STXBP5L
  Gene Name: syntaxin binding protein 5-like
  Uniprot ID: Q9Y2K9
  ENSP ID: ENSP00000420642
MKKFNFRKVLDGLTASSPGSGSSSGSNSGGGAGSGSVHPAGTAGVLREEIQETLTSEYFQICKFGMVFLISPQH

SEQ ID NO: 86090 - protein, 1026 aa, Homo sapiens
  Payload ID: 17093
  Gene Symbol: STXBP5L
  Gene Name: syntaxin binding protein 5-like
  ENSP ID: ENSP00000420666
MKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIADNFCMRGLSNFYPDLTKRIRTSYQSLTELNDSPVPLELERCKSPTSDHVNGHCTSPTSQSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMRYLPSYKLSGNHNNTSKVQS

SEQ ID NO: 86091 - protein, 210 aa, Homo sapiens
  Payload ID: 17094
  Gene Symbol: STXBP6
  Gene Name: syntaxin binding protein 6 (amisyn)
  Uniprot ID: Q8NFX7
  ENSP ID: ENSP00000324302
MSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 86092 - protein, 210 aa, Homo sapiens; identical to SEQ ID NO: 86091
  Payload ID: 17094
  Gene Symbol: STXBP6
  Gene Name: syntaxin binding protein 6 (amisyn)
  Uniprot ID: Q8NFX7
  ENSP ID: ENSP00000379928

SEQ ID NO: 86093 - protein, 210 aa, Homo sapiens; identical to SEQ ID NO: 86091
  Payload ID: 17094
  Gene Symbol: STXBP6
  Gene Name: syntaxin binding protein 6 (amisyn)
  Uniprot ID: Q8NFX7
  ENSP ID: ENSP00000397212

SEQ ID NO: 86094 - protein, 65 aa, Homo sapiens
  Payload ID: 17094
  Gene Symbol: STXBP6
  Gene Name: syntaxin binding protein 6 (amisyn)
  ENSP ID: ENSP00000447268
MSAKSAISKEIFAPLDERMLGAVQVKRRTKKKIPFLATGGQGEYLTYICLSDIKSASKEKTFSEF

SEQ ID NO: 86095 - protein, 108 aa, Homo sapiens
  Payload ID: 17094
  Gene Symbol: STXBP6
  Gene Name: syntaxin binding protein 6 (amisyn)
  Uniprot ID: Q8NFX7
  ENSP ID: ENSP00000447655
MSACFLDTRRAAFLQCDLPSSYRILTLPESGHCGSAEPVSDAPALLLSGNSILHSAADSVTSAVQKASQALNERGERLGRAEEKTEDLKNSAQQFAETAHKLAMKHKC

SEQ ID NO: 86096 - protein, 210 aa, Homo sapiens; identical to SEQ ID NO: 86091
  Payload ID: 17094
  Gene Symbol: STXBP6
  Gene Name: syntaxin binding protein 6 (amisyn)
  Uniprot ID: Q8NFX7
  ENSP ID: ENSP00000449379

SEQ ID NO: 86097 - protein, 210 aa, Homo sapiens; identical to SEQ ID NO: 86091
  Payload ID: 17094
  Gene Symbol: STXBP6
  Gene Name: syntaxin binding protein 6 (amisyn)
  Uniprot ID: Q8NFX7
  ENSP ID: ENSP00000449536

SEQ ID NO: 86098 - protein, 505 aa, Homo sapiens
  Payload ID: 17095
  Gene Symbol: SNTA1
  Gene Name: syntrophin, alpha 1
  Uniprot ID: Q13424
  ENSP ID: ENSP00000217381
MASGRRAPRTGLLELRAGAGSGAGGERWQRVLLSLAEDVLTVSPADGDPGPEPGAPREQEPAQLNGAAEPGAGPPQLPEALLLQRRRVTVRKADAGGLGISIKGGRENKMPILISKIFKGLAADQTEALFVGDAILSVNGEDLSSATHDEAVQVLKKTGKEVVLEVKYMKDVSPYFKNSTGGTSVGWDSPPASPLQRQPSSPGPTPRNFSEAKHMSLKMAYVSKRCTPNDPEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTACTWNGRPCSLSVHIDKGFTLWAAEPGAARAVLLRQPFEKLQMSSDDGASLLFLDFGGAEGEIQLDLHSCPKTIVFIIHSFLSAKVTRLGLLA

SEQ ID NO: 86099 - protein, 538 aa, Homo sapiens [sequence omitted]

SEQ ID NO: 86100 - protein, 28 aa, Homo sapiens
  Payload ID: 17096
  Gene Symbol: SNTB1
  Gene Name: syntrophin, beta 1 (dystrophin-associated protein A1, 59kDa, basic component 1)
  ENSP ID: ENSP00000429292
MAVAAAAAAAGPAGAGGGRAQRSGLLEV

SEQ ID NO: 86101 - protein, 538 aa, Homo sapiens [sequence omitted]

SEQ ID NO: 86102 - protein, 540 aa, Homo sapiens
  Payload ID: 17097
  Gene Symbol: SNTB2
  Gene Name: syntrophin, beta 2 (dystrophin-associated protein A1, 59kDa, basic component 2)
  Uniprot ID: Q13425
  ENSP ID: ENSP00000338191
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWFVAIHTNIMALLPQVLAELNAMLGATSTAGGSKEVKHIAWLAEQAKLDGGRQQWRPVLMAVTEKDLLLYDCMPWTRDAWASPCHSYPLVATRLVHSGSGCRSPSLGSDLTFATRTGSRQGIEMHLFRVETHRDLSSWTRILVQGCHAAAELIKEVSLGCMLNGQEVRLTIHYENGFTISRENGGSSSILYRYPFERLKMSADDGIRNLYLDFGGPEGELTMDLHSCPKPIVFVLHTFLSAKVTRMGLLV

SEQ ID NO: 86103 - protein, 139 aa, Homo sapiens
  Payload ID: 17097
  Gene Symbol: SNTB2
  Gene Name: syntrophin, beta 2 (dystrophin-associated protein A1, 59kDa, basic component 2)
  ENSP ID: ENSP00000353686
  MOD_RES (1)..(1): Any amino acid
XPHLQDLPRAGCRPEPGAAAGRRHPVGERHRPAPGHPRPGRAGAEARGQGVKFIREVTPYIKKPSLVSDLPWEGAAPQSPSFSGSEDSGSPKHQNSTKDRKIIPLKMCFAARNLSMPDLENRLIELHSPDSRNTLILRC

SEQ ID NO: 86104 - protein, 162 aa, Homo sapiens
  Payload ID: 17097
  Gene Symbol: SNTB2
  Gene Name: syntrophin, beta 2 (dystrophin-associated protein A1, 59kDa, basic component 2)
  ENSP ID: ENSP00000432201
  MOD_RES (1)..(1): Any amino acid
XGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWQN

SEQ ID NO: 86105 - protein, 267 aa, Homo sapiens
  Payload ID: 17097
  Gene Symbol: SNTB2
  Gene Name: syntrophin, beta 2 (dystrophin-associated protein A1, 59kDa, basic component 2)
  Uniprot ID: Q13425
  ENSP ID: ENSP00000436443
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRQN

SEQ ID NO: 86106 - protein, 50 aa, Homo sapiens
  Payload ID: 17097
  Gene Symbol: SNTB2
  Gene Name: syntrophin, beta 2 (dystrophin-associated protein A1, 59kDa, basic component 2)
  ENSP ID: ENSP00000458573
  MOD_RES (1)..(1): Any amino acid
XPHLQDLPRAGCRPEPGAAAGRRHPVGERHRPAPGHPRPGRAGAEARGQG

SEQ ID NO: 86107 - protein, 62 aa, Homo sapiens
  Payload ID: 17097
  Gene Symbol: SNTB2
  Gene Name: syntrophin, beta 2 (dystrophin-associated protein A1, 59kDa, basic component 2)
  ENSP ID: ENSP00000459910
  MOD_RES (1)..(1): Any amino acid
XGRENRMPILISKIFPGLAADQSRALRLGDAILSVNGTDLRQATHDQAVQALKRAGKEVLLE

SEQ ID NO: 86108 - protein, 193 aa, Homo sapiens
  Payload ID: 17097
  Gene Symbol: SNTB2
  Gene Name: syntrophin, beta 2 (dystrophin-associated protein A1, 59kDa, basic component 2)
  ENSP ID: ENSP00000461506
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLE

SEQ ID NO: 86109 - protein, 193 aa, Homo sapiens; identical to SEQ ID NO: 86108
  Payload ID: 17097
  Gene Symbol: SNTB2
  Gene Name: syntrophin, beta 2 (dystrophin-associated protein A1, 59kDa, basic component 2)
  ENSP ID: ENSP00000461734

SEQ ID NO: 86110 - protein, 64 aa, Homo sapiens
  Payload ID: 17097
  Gene Symbol: SNTB2
  Gene Name: syntrophin, beta 2 (dystrophin-associated protein A1, 59kDa, basic component 2)
  ENSP ID: ENSP00000462765
  MOD_RES (1)..(1): Any amino acid
XGRENRMPILISKIFPGLAADQSRALRLGDAILSVNGTDLRQATHDQAVQALKRAGKEVLLEGL

SEQ ID NO: 86111 - protein, 62 aa, Homo sapiens; identical to SEQ ID NO: 86107
  Payload ID: 17097
  Gene Symbol: SNTB2
  Gene Name: syntrophin, beta 2 (dystrophin-associated protein A1, 59kDa, basic component 2)
  ENSP ID: ENSP00000478662
  MOD_RES (1)..(1): Any amino acid

SEQ ID NO: 86112 - protein, 480 aa, Homo sapiens
  Payload ID: 17098
  Gene Symbol: SNTG1
  Gene Name: syntrophin, gamma 1
  Uniprot ID: Q9NSN8
  ENSP ID: ENSP00000276467
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKELEFSNLFAVLHCIHSFFAAKVACLDPLFLGNQATASTAASSATTSKAKYTT

SEQ ID NO: 86113 - protein, 348 aa, Homo sapiens
  Payload ID: 17098
  Gene Symbol: SNTG1
  Gene Name: syntrophin, gamma 1
  ENSP ID: ENSP00000428558
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKPV

SEQ ID NO: 86114 - protein, 517 aa, Homo sapiens
  Payload ID: 17098
  Gene Symbol: SNTG1
  Gene Name: syntrophin, gamma 1
  Uniprot ID: Q9NSN8
  ENSP ID: ENSP00000429276
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKAVLWRYKFSQLKGSSDDGKSKIKFLFQNPDTKQIEAKELEFSNLFAVLHCIHSFFAAKVACLDPLFLGNQATASTAASSATTSKAKYTT

SEQ ID NO: 86115 - protein, 92 aa, Homo sapiens
  Payload ID: 17098
  Gene Symbol: SNTG1
  Gene Name: syntrophin, gamma 1
  ENSP ID: ENSP00000429363
MDFRTACEETKTGICLLQDGNQEPFKVRLHLAKDILMIQEQDVICVSGEPFYSGERTVTIRRQTVGGFGLSIKGGAEHNIPVVVSKISKEQR

SEQ ID NO: 86116 - protein, 517 aa, Homo sapiens; identical to SEQ ID NO: 86114
  Payload ID: 17098
  Gene Symbol: SNTG1
  Gene Name: syntrophin, gamma 1
  Uniprot ID: Q9NSN8
  ENSP ID: ENSP00000429842

SEQ ID NO: 86117 - protein, 120 aa, Homo sapiens
  Payload ID: 17098
  Gene Symbol: SNTG1
  Gene Name: syntrophin, gamma 1
  ENSP ID: ENSP00000430748
  MOD_RES (1)..(1): Any amino acid
XQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILK

SEQ ID NO: 86118 - protein, 480 aa, Homo sapiens; identical to SEQ ID NO: 86112
  Payload ID: 17098
  Gene Symbol: SNTG1
  Gene Name: syntrophin, gamma 1
  Uniprot ID: Q9NSN8
  ENSP ID: ENSP00000431123

SEQ ID NO: 86119 - protein, 517 aa, Homo sapiens; identical to SEQ ID NO: 86114
  Payload ID: 17098
  Gene Symbol: SNTG1
  Gene Name: syntrophin, gamma 1
  Uniprot ID: Q9NSN8
  ENSP ID: ENSP00000483474

SEQ ID NO: 86120 - protein, 539 aa, Homo sapiens
  Payload ID: 17099
  Gene Symbol: SNTG2
  Gene Name: syntrophin, gamma 2
  Uniprot ID: Q9NY99
  ENSP ID: ENSP00000311837
MGTEGPPPPAASRGRQGCLLVPARTKTTIALLYDEESENAYDIRLKLTKEVLTIQKQDVVCVGGSHQGRNRRTVTLRRQPVGGLGLSIKGGSEHNVPVVISKIFEDQAADQTGMLFVGDAVLQVNGIHVENATHEEVVHLLRNAGDEVTITVEYLREAPAFLKLPLGSPGPSSDHSSGASSPLFDSGLHLNGNSSTTAPSSPSSPIAKDPRYEKRWLDTLSVPLSMARISRYKAGTEKLRWNAFEVLALDGVSSGILRFYTAQDGTDWLRAVSANIRELTLQNMKMANKCCSPSDQVVHMGWVNEKLQGADSSQTFRPKFLALKGPSFYVFSTPPVSTFDWVRAERTYHLCEVLFKVHKFWLTEDCWLQANLYLGLQDFDFEDQRPYCFSIVAGHGKSHVFNVELGSELAMWEKSFQRATFMEVQRTGSRTYMCSWQGEMLCFTVDFALGFTCFESKTKNVLWRFKFSQLKGSSDDGKTRVKLLFQNLDTKQIETKELEFQDLRAVLHCIHSFIAAKVASVDPGFMDSQSLARKYMYSS

SEQ ID NO: 86121 - protein, 412 aa, Homo sapiens
  Payload ID: 17099
  Gene Symbol: SNTG2
  Gene Name: syntrophin, gamma 2
  Uniprot ID: Q9NY99
  ENSP ID: ENSP00000385020
MGTEGPPPPAASRGRQGCLLVPARTKTTIALLYDEESENAYDIRLKLTKEVLTIQKQDVVCVGGSHQGRNAPSSPSSPIAKDPRYEKRWLDTLSVPLSMARISRYKAGTEKLRWNAFEVLALDGVSSGILRFYTAQDGTDWLRAVSANIRELTLQNMKMANKCCSPSDQVVHMGWVNEKLQGADSSQTFRPKFLALKGPSFYVFSTPPVSTFDWVRAERTYHLCEVLFKVHKFWLTEDCWLQANLYLGLQDFDFEDQRPYCFSIVAGHGKSHVFNVELGSELAMWEKSFQRATFMEVQRTGSRTYMCSWQGEMLCFTVDFALGFTCFESKTKNVLWRFKFSQLKGSSDDGKTRVKLLFQNLDTKQIETKELEFQDLRAVLHCIHSFIAAKVASVDPGFMDSQSLARKYMYSS

SEQ ID NO: 86122 - protein, 129 aa, Homo sapiens
  Payload ID: 17099
  Gene Symbol: SNTG2
  Gene Name: syntrophin, gamma 2
  ENSP ID: ENSP00000401997
MGTEGPPPPAASRGRQGCLLVPARTKTTIALLYDEESENAYDIRLKLTKEVLTIQKQDVVCVGGSHQGRNRRTVTLRRQPVGGLGLSIKGGSEHNVPVVISKIFEDQADGVLLCRPGWSAVLTRQGCCS

SEQ ID NO: 86123 - protein, 129 aa, Homo sapiens; identical to SEQ ID NO: 86122
  Payload ID: 17099
  Gene Symbol: SNTG2
  Gene Name: syntrophin, gamma 2
  ENSP ID: ENSP00000412249

SEQ ID NO: 86124 - protein, 80 aa, Homo sapiens
  Payload ID: 17099
  Gene Symbol: SNTG2
  Gene Name: syntrophin, gamma 2
  ENSP ID: ENSP00000486175
NVLWRFKFSQLKGSSDDGKTRVKLLFQNLDTKQIEMKELEFQDLRAVLHCIHSFIAAKVASVDPGFMDSQSLARKYMYSS

SEQ ID NO: 86125 - protein, 231 aa, Homo sapiens
  Payload ID: 17099
  Gene Symbol: SNTG2
  Gene Name: syntrophin, gamma 2
  ENSP ID: ENSP00000486519
APSSPSSPIAKDPRYEKRWLDTLSVPLSMARISRYKAGTEKLRWNAFEVLALDGVSSGILRFYTAQDGTDWLRAVSANIRELTLQNMKMANKCCSPSDQVVHMGWVNEKLQGADSSQTFRPKFLALKGPSFYVFSTPPVSTFDWVRAERTYHLCEVLFKVHKFWLTEDCWLQANLYLGLQDFDFEDQRPYCFSIVAGHGKSHVFNVELGSELAMWEKSFQRATFMEVQRTG

SEQ ID NO: 86126 - protein, 80 aa, Homo sapiens; identical to SEQ ID NO: 86124
  Payload ID: 17099
  Gene Symbol: SNTG2
  Gene Name: syntrophin, gamma 2
  ENSP ID: ENSP00000487429

SEQ ID NO: 86127 - protein, 140 aa, Homo sapiens
  Payload ID: 17100
  Gene Symbol: SNCA
  Gene Name: synuclein, alpha (non A4 component of amyloid precursor)
  Uniprot ID: P37840
  ENSP ID: ENSP00000338345
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 86128 - protein, 112 aa, Homo sapiens
  Payload ID: 17100
  Gene Symbol: SNCA
  Gene Name: synuclein, alpha (non A4 component of amyloid precursor)
  Uniprot ID: P37840
  ENSP ID: ENSP00000343683
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKEGYQDYEPEA

SEQ ID NO: 86129 - protein, 140 aa, Homo sapiens; identical to SEQ ID NO: 86127
  Payload ID: 17100
  Gene Symbol: SNCA
  Gene Name: synuclein, alpha (non A4 component of amyloid precursor)
  Uniprot ID: P37840
  ENSP ID: ENSP00000378437

SEQ ID NO: 86130 - protein, 126 aa, Homo sapiens
  Payload ID: 17100
  Gene Symbol: SNCA
  Gene Name: synuclein, alpha (non A4 component of amyloid precursor)
  Uniprot ID: P37840
  ENSP ID: ENSP00000378440
MDVFMKGLSKAKEGVVAAAEKTKQGVAEAAGKTKEGVLYVVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 86131 - protein, 140 aa, Homo sapiens; identical to SEQ ID NO: 86127
  Payload ID: 17100
  Gene Symbol: SNCA
  Gene Name: synuclein, alpha (non A4 component of amyloid precursor)
  Uniprot ID: P37840
  ENSP ID: ENSP00000378442

SEQ ID NO: 86132 - protein, 112 aa, Homo sapiens; identical to SEQ ID NO: 86128
  Payload ID: 17100
  Gene Symbol: SNCA
  Gene Name: synuclein, alpha (non A4 component of amyloid precursor)
  Uniprot ID: P37840
  ENSP ID: ENSP00000396241

SEQ ID NO: 86133 - protein, 126 aa, Homo sapiens; identical to SEQ ID NO: 86130
  Payload ID: 17100
  Gene Symbol: SNCA
  Gene Name: synuclein, alpha (non A4 component of amyloid precursor)
  Uniprot ID: P37840
  ENSP ID: ENSP00000421485

SEQ ID NO: 86134 - protein, 140 aa, Homo sapiens; identical to SEQ ID NO: 86127
  Payload ID: 17100
  Gene Symbol: SNCA
  Gene Name: synuclein, alpha (non A4 component of amyloid precursor)
  Uniprot ID: P37840
  ENSP ID: ENSP00000422238

SEQ ID NO: 86135 - protein, 66 aa, Homo sapiens
  Payload ID: 17100
  Gene Symbol: SNCA
  Gene Name: synuclein, alpha (non A4 component of amyloid precursor)
  ENSP ID: ENSP00000423445
MDVFMKGLSKAKEGVVAAAEKTKQGVAEAAGKTKEGVLYVGSKTKEGVVHGVATVAEKTKEQVTNV

SEQ ID NO: 86136 - protein, 115 aa, Homo sapiens
  Payload ID: 17100
  Gene Symbol: SNCA
  Gene Name: synuclein, alpha (non A4 component of amyloid precursor)
  ENSP ID: ENSP00000426034
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKVWLCTFCVTFISW

SEQ ID NO: 86137 - protein, 140 aa, Homo sapiens; identical to SEQ ID NO: 86127
  Payload ID: 17100
  Gene Symbol: SNCA
  Gene Name: synuclein, alpha (non A4 component of amyloid precursor)
  Uniprot ID: P37840
  ENSP ID: ENSP00000426955

SEQ ID NO: 86138 - protein, 98 aa, Homo sapiens
  Payload ID: 17100
  Gene Symbol: SNCA
  Gene Name: synuclein, alpha (non A4 component of amyloid precursor)
  ENSP ID: ENSP00000479604
MDVFMKGLSKAKEGVVAAAEKTKQGVAEAAGKTKEGVLYVVAEKTKEQVTNVGGAVVTGVTAVAQKTVEGAGSIAAATGFVKKDQLGKEGYQDYEPEA

SEQ ID NO: 86139 - protein, 126 aa, Homo sapiens; identical to SEQ ID NO: 86130
  Payload ID: 17100
  Gene Symbol: SNCA
  Gene Name: synuclein, alpha (non A4 component of amyloid precursor)
  Uniprot ID: P37840
  ENSP ID: ENSP00000484044

SEQ ID NO: 86140 - protein, 1016 aa, Homo sapiens
  Payload ID: 17101
  Gene Symbol: SNCAIP
  Gene Name: synuclein, alpha interacting protein
  Uniprot ID: Q9Y6H5
  ENSP ID: ENSP00000261367
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAEMYSSCINLSSNMLIEEHLCNDTRHNDINRKMKKSYSIKHIAEPESKELFL

SEQ ID NO: 86141 - protein, 919 aa, Homo sapiens
  Payload ID: 17101
  Gene Symbol: SNCAIP
  Gene Name: synuclein, alpha interacting protein
  Uniprot ID: Q9Y6H5
  ENSP ID: ENSP00000261368
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 86142 - protein, 603 aa, Homo sapiens
  Payload ID: 17101
  Gene Symbol: SNCAIP
  Gene Name: synuclein, alpha interacting protein
  Uniprot ID: Q9Y6H5
  ENSP ID: ENSP00000368854
MTYLIQSHHSRRSQNCAEDVIRKTKTDQNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAEMYSSCINLSSNMLIEEHLCNDTRHNDINRKMKKSYSIKHIAEPESKELFL

SEQ ID NO: 86143 - protein, 88 aa, Homo sapiens
  Payload ID: 17101
  Gene Symbol: SNCAIP
  Gene Name: synuclein, alpha interacting protein
  ENSP ID: ENSP00000378849
MEAPEYLDLDEIDFSDDISYSVTSLKTIPELCRRCDTQNEDRSATPSCRQSRQNSRRKWKQSITYCGVTGTRRVSTAPHFFDGRRLPQ

SEQ ID NO: 86144 - protein, 588 aa, Homo sapiens
  Payload ID: 17101
  Gene Symbol: SNCAIP
  Gene Name: synuclein, alpha interacting protein
  Uniprot ID: Q9Y6H5
  ENSP ID: ENSP00000378852
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTRLKIQGTWNGSETCLFTHHFSSYPPISSGLQCQGQEGVLFIPDQVGAATNKQVLFQNQLPETKSSY

SEQ ID NO: 86145 - protein, 62 aa, Homo sapiens
  Payload ID: 17101
  Gene Symbol: SNCAIP
  Gene Name: synuclein, alpha interacting protein
  ENSP ID: ENSP00000394392
MEAPEYLDLDEIDFSDDISYSVTSLKTIPELCRRCDTQNEDRSGKDSSVASSVYARTGHLVG

SEQ ID NO: 86146 - protein, 858 aa, Homo sapiens
  Payload ID: 17101
  Gene Symbol: SNCAIP
  Gene Name: synuclein, alpha interacting protein
  ENSP ID: ENSP00000422106
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKA

SEQ ID NO: 86147 - protein, 98 aa, Homo sapiens
  Payload ID: 17101
  Gene Symbol: SNCAIP
  Gene Name: synuclein, alpha interacting protein
  ENSP ID: ENSP00000422610
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQK

SEQ ID NO: 86148 - protein, 113 aa, Homo sapiens
  Payload ID: 17101
  Gene Symbol: SNCAIP
  Gene Name: synuclein, alpha interacting protein
  ENSP ID: ENSP00000423360
MEAPEYLDLDEIDFSDDISDNRSQGNRLQKLGLEDTDREDAMGFGSHRAKLTVVAALGACHCPENEYSVTSLKTIPELCRRCDTQNEDRSEWSVGVRTLDGERNRSHCRTELF

SEQ ID NO: 86149 - protein, 66 aa, Homo sapiens
  Payload ID: 17101
  Gene Symbol: SNCAIP
  Gene Name: synuclein, alpha interacting protein
  ENSP ID: ENSP00000424338
MEAPEYLDLDEIDFSDDISYSVTSLKTIPELCRRCDTQNEDRSEWSVGVRTLDGERNRSHCRTELF

SEQ ID NO: 86150 - protein, 67 aa, Homo sapiens
  Payload ID: 17101
  Gene Symbol: SNCAIP
  Gene Name: synuclein, alpha interacting protein
  ENSP ID: ENSP00000425063
MEAPEYLDLDEIDFSDDISDNRSQGNRLQKLGLEDTDREDAMGFGSHRAKLTVVAALGACHCPENEY

SEQ ID NO: 86151 - protein, 66 aa, Homo sapiens; identical to SEQ ID NO: 86149
  Payload ID: 17101
  Gene Symbol: SNCAIP
  Gene Name: synuclein, alpha interacting protein
  ENSP ID: ENSP00000426280

SEQ ID NO: 86152 - protein, 66 aa, Homo sapiens; identical to SEQ ID NO: 86149
  Payload ID: 17101
  Gene Symbol: SNCAIP
  Gene Name: synuclein, alpha interacting protein
  ENSP ID: ENSP00000426526

SEQ ID NO: 86153 - protein, 160 aa, Homo sapiens
  Payload ID: 17101
  Gene Symbol: SNCAIP
  Gene Name: synuclein, alpha interacting protein
  ENSP ID: ENSP00000426551
MEAPEYLDLDEIDFSDDISDNRSQGNRLQKLGLEDTDREDAMGFGSHRAKLTVVAALGACHCPENEYSVTSLKTIPELCRRCDTQNEDRSVSSSSWNCGISTLITNTQKPTGIADVYSKFRPVKRVSPLKHQPETLENNESDDQKNQKVVEYQKGGESDL

SEQ ID NO: 86154 - protein, 88 aa, Homo sapiens; identical to SEQ ID NO: 86143
  Payload ID: 17101
  Gene Symbol: SNCAIP
  Gene Name: synuclein, alpha interacting protein
  ENSP ID: ENSP00000426904

SEQ ID NO: 86155 - protein, 62 aa, Homo sapiens; identical to SEQ ID NO: 86145
  Payload ID: 17101
  Gene Symbol: SNCAIP
  Gene Name: synuclein, alpha interacting protein
  ENSP ID: ENSP00000427078

SEQ ID NO: 86156 - protein, 135 aa, Homo sapiens
  Payload ID: 17101
  Gene Symbol: SNCAIP
  Gene Name: synuclein, alpha interacting protein
  ENSP ID: ENSP00000427090
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSE

SEQ ID NO: 86157 - protein, 66 aa, Homo sapiens; identical to SEQ ID NO: 86149
  Payload ID: 17101
  Gene Symbol: SNCAIP
  Gene Name: synuclein, alpha interacting protein
  ENSP ID: ENSP00000427575

SEQ ID NO: 86158 - protein, 14 aa, Homo sapiens
  Payload ID: 17101
  Gene Symbol: SNCAIP
  Gene Name: synuclein, alpha interacting protein
  ENSP ID: ENSP00000427587
MEAPEYLDLDEIDF

SEQ ID NO: 86159 - protein, 113 aa, Homo sapiens; identical to SEQ ID NO: 86148
  Payload ID: 17101
  Gene Symbol: SNCAIP
  Gene Name: synuclein, alpha interacting protein
  ENSP ID: ENSP00000441681

SEQ ID NO: 86160 - protein, 134 aa, Homo sapiens
  Payload ID: 17102
  Gene Symbol: SNCB
  Gene Name: synuclein, beta
  Uniprot ID: Q16143
  ENSP ID: ENSP00000308057
MDVFMKGLSMAKEGVVAAAEKTKQGVTEAAEKTKEGVLYVGSKTREGVVQGVASVAEKTKEQASHLGGAVFSGAGNIAAATGLVKREEFPTDLKPEEVAQEAAEEPLIEPLMEPEGESYEDPPQEEYQEYEPEA

SEQ ID NO: 86161 - protein, 134 aa, Homo sapiens; identical to SEQ ID NO: 86160
  Payload ID: 17102
  Gene Symbol: SNCB
  Gene Name: synuclein, beta
  Uniprot ID: Q16143
  ENSP ID: ENSP00000377296

SEQ ID NO: 86162 - protein, 134 aa, Homo sapiens; identical to SEQ ID NO: 86160
  Payload ID: 17102
  Gene Symbol: SNCB
  Gene Name: synuclein, beta
  Uniprot ID: Q16143
  ENSP ID: ENSP00000422223

SEQ ID NO: 86163 - protein, 134 aa, Homo sapiens; identical to SEQ ID NO: 86160
  Payload ID: 17102
  Gene Symbol: SNCB
  Gene Name: synuclein, beta
  Uniprot ID: Q16143
  ENSP ID: ENSP00000424073

SEQ ID NO: 86164 - protein, 120 aa, Homo sapiens
  Payload ID: 17102
  Gene Symbol: SNCB
  Gene Name: synuclein, beta
  ENSP ID: ENSP00000479489
MDVFMKGLSMAKEGVVAAAEKTKQGVTEAAEKTKEGVLYVVAEKTKEQASHLGGAVFSGAGNIAAATGLVKREEFPTDLKPEEVAQEAAEEPLIEPLMEPEGESYEDPPQEEYQEYEPEA

SEQ ID NO: 86165 - protein, 126 aa, Homo sapiens
  Payload ID: 17103
  Gene Symbol: SNCG
  Gene Name: synuclein, gamma (breast cancer-specific protein 1)
  ENSP ID: ENSP00000344658
MDVFKKGFSIAKEGVVGAVEKTKQGVTEAAEKTKEGVMYVGAKTKENVVQSVTSGLPWGWGWGGGQPVSSHSGREDQGAGQRRERGCGEQRQHCGHQDRGGGGEHRGHLRGGAQGGLEAICPPTGG

SEQ ID NO: 86166 - protein, 127 aa, Homo sapiens
  Payload ID: 17103
  Gene Symbol: SNCG
  Gene Name: synuclein, gamma (breast cancer-specific protein 1)
  Uniprot ID: O76070
  ENSP ID: ENSP00000361087
MDVFKKGFSIAKEGVVGAVEKTKQGVTEAAEKTKEGVMYVGAKTKENVVQSVTSVAEKTKEQANAVSEAVVSSVNTVATKTVEEAENIAVTSGVVRKEDLRPSAPQQEGEASKEKEEVAEEAQSGGD

SEQ ID NO: 86167 - protein, 156 aa, Homo sapiens
  Payload ID: 17104
  Gene Symbol: SYS1
  Gene Name: Sys1 golgi trafficking protein
  Uniprot ID: Q8N2H4
  ENSP ID: ENSP00000243918
MAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 86168 - protein, 156 aa, Homo sapiens; identical to SEQ ID NO: 86167
  Payload ID: 17104
  Gene Symbol: SYS1
  Gene Name: Sys1 golgi trafficking protein
  Uniprot ID: Q8N2H4
  ENSP ID: ENSP00000361812

SEQ ID NO: 86169 - protein, 57 aa, Homo sapiens
  Payload ID: 17104
  Gene Symbol: SYS1
  Gene Name: Sys1 golgi trafficking protein
  ENSP ID: ENSP00000397601
MAGQFRSYVWDPLLILSQIVLMQTVYYGSLGLWLALVDGLVRSSPSLDQMFDAEEAC

SEQ ID NO: 86170 - protein, 135 aa, Homo sapiens
  Payload ID: 17104
  Gene Symbol: SYS1
  Gene Name: Sys1 golgi trafficking protein
  ENSP ID: ENSP00000403071
MQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 86171 - protein, 118 aa, Homo sapiens
  Payload ID: 17104
  Gene Symbol: SYS1
  Gene Name: Sys1 golgi trafficking protein
  ENSP ID: ENSP00000406879
MAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALT

SEQ ID NO: 86172 - protein, 76 aa, Homo sapiens
  Payload ID: 17104
  Gene Symbol: SYS1
  Gene Name: Sys1 golgi trafficking protein
  Uniprot ID: Q8N2H4
  ENSP ID: ENSP00000416506
MAGQFRSYVWDPLLILSQIVLMQTVYYGSLGLWLALVDGLVRSSPSLDQMFDAEILGFSTPPGRLSMMSFILNALT

SEQ ID NO: 86173 - protein, 78 aa, Homo sapiens
  Payload ID: 17105
  Gene Symbol: SYS1-DBNDD2
  Gene Name: SYS1-DBNDD2 readthrough (NMD candidate)
  ENSP ID: ENSP00000456116
MAGQFRSYVWDPLLILSQIVLMQTVYYGSLGLWLALVDGLVRSSPSLDQMFDAEILGFSTPPGRLSMMSFILNALTWS

SEQ ID NO: 86174 - protein, 78 aa, Homo sapiens; identical to SEQ ID NO: 86173
  Payload ID: 17105
  Gene Symbol: SYS1-DBNDD2
  Gene Name: SYS1-DBNDD2 readthrough (NMD candidate)
  ENSP ID: ENSP00000457650

SEQ ID NO: 86175 - protein, 97 aa, Homo sapiens
  Payload ID: 17105
  Gene Symbol: SYS1-DBNDD2
  Gene Name: SYS1-DBNDD2 readthrough (NMD candidate)
  ENSP ID: ENSP00000457768
MAGQFRSYVWDPLLILSQIVLMQTVYYGSLGLWLALVDGLVRSSPSLDQMFDAEILGFSTPPGRLSMMSFILNALTWHFSLLLPHEEGRVCFPFHHD

SEQ ID NO: 86176 - protein, 435 aa, Homo sapiens
  Payload ID: 17106
  Gene Symbol: T
  Gene Name: T brachyury transcription factor
  Uniprot ID: O15178
  ENSP ID: ENSP00000296946
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQWGWLLPGTSTLCPPANPHPQFGGALSLPSTHSCDRYPTLRSHRSSPYPSPYAHRNNSPTYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYEGAAAATDIVDSQYDAAAQGRLIASWTPVSPPSM

SEQ ID NO: 86177 - protein, 377 aa, Homo sapiens
  Payload ID: 17106
  Gene Symbol: T
  Gene Name: T brachyury transcription factor
  Uniprot ID: O15178
  ENSP ID: ENSP00000355836
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQSYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYEGAAAATDIVDSQYDAAAQGRLIASWTPVSPPSM

SEQ ID NO: 86178 - protein, 403 aa, Homo sapiens
  Payload ID: 17106
  Gene Symbol: T
  Gene Name: T brachyury transcription factor
  ENSP ID: ENSP00000355841
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQSGGWLLPGTSTLCPPANPHPQFGGALSLPSTHSCDRYPTLRSHRSSPYPSPYAHRNNSPTYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYE

SEQ ID NO: 86179 - protein, 243 aa, Homo sapiens
  Payload ID: 17106
  Gene Symbol: T
  Gene Name: T brachyury transcription factor
  ENSP ID: ENSP00000453512
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQ

SEQ ID NO: 86180 - protein, 496 aa, Homo sapiens
  Payload ID: 17107
  Gene Symbol: TCAIM
  Gene Name: T cell activation inhibitor, mitochondrial
  Uniprot ID: Q8N3R3
  ENSP ID: ENSP00000341539
MFCHLRPMRRLCLEKIFPHWFPFSRALSGAEAVNALRPFYFAVHPDFFGQHPVEREINENSLKRLSVYLENLQKPGFKSLKPTQLTFYVRETDQSSSDGQEPFSTSGFRAVKFTLHTRDLLSTVLYILNSCSLSVEHIQSLNTNMHTQPLKEAKRMPDRPIKWDKSYYSFTGFKDPDEDLEQVSRVETTLTSWLDNNGKSAVKKLKNSLPLRKELDRLKDELSHQLQLSDIRWQRSWGIAHRCSQLHSLSRLAQQNLETLKKAKGCTIIFTDRSGMSAVGHVMLGTMDVHHHWTKLFERLPSYFDLQRRLMILEDQISYLLGGIQVVYIEELQPVLTLEEYYSLLDVFYNRLLKSRILFHPRSLRGLQMILNSDRYAPSLHELGHFNIPTLCDPANLQWFILTKAQQARENMKRKEELKVIENELIQASTKKFSLEKLYKEPSISSIQMVDCCKRLLEQSLPYLHGMHLCISHFYSVMQDGDLCIPWNWKNGEAIK

SEQ ID NO: 86181 - protein, 70 aa, Homo sapiens
  Payload ID: 17107
  Gene Symbol: TCAIM
  Gene Name: T cell activation inhibitor, mitochondrial
  Uniprot ID: Q8N3R3
  ENSP ID: ENSP00000373252
MFCHLRPMRRLCLEKIFPHWFPFSRALSGAEAVNALRPFYFAVHPDFFGQHPVERDDTWKSFQCPSDFSL

SEQ ID NO: 86182 - protein, 70 aa, Homo sapiens; identical to SEQ ID NO: 86181
  Payload ID: 17107
  Gene Symbol: TCAIM
  Gene Name: T cell activation inhibitor, mitochondrial
  Uniprot ID: Q8N3R3
  ENSP ID: ENSP00000379388

SEQ ID NO: 86183 - protein, 115 aa, Homo sapiens
  Payload ID: 17107
  Gene Symbol: TCAIM
  Gene Name: T cell activation inhibitor, mitochondrial
  Uniprot ID: Q8N3R3
  ENSP ID: ENSP00000387842
MFCHLRPMRRLCLEKIFPHWFPFSRALSGAEAVNALRPFYFAVHPDFFGQHPVEREINENSLKRLSVYLENLQKPGFKSLKPTQLTFYVRETDQSSSDGQEPFSTSVYLLNISKA

SEQ ID NO: 86184 - protein, 115 aa, Homo sapiens; identical to SEQ ID NO: 86183
  Payload ID: 17107
  Gene Symbol: TCAIM
  Gene Name: T cell activation inhibitor, mitochondrial
  Uniprot ID: Q8N3R3
  ENSP ID: ENSP00000392032

SEQ ID NO: 86185 - protein, 496 aa, Homo sapiens; identical to SEQ ID NO: 86180
  Payload ID: 17107
  Gene Symbol: TCAIM
  Gene Name: T cell activation inhibitor, mitochondrial
  Uniprot ID: Q8N3R3
  ENSP ID: ENSP00000402581

SEQ ID NO: 86186 - protein, 115 aa, Homo sapiens; identical to SEQ ID NO: 86183
  Payload ID: 17107
  Gene Symbol: TCAIM
  Gene Name: T cell activation inhibitor, mitochondrial
  Uniprot ID: Q8N3R3
  ENSP ID: ENSP00000402604

SEQ ID NO: 86187 - protein, 115 aa, Homo sapiens
  Payload ID: 17107
  Gene Symbol: TCAIM
  Gene Name: T cell activation inhibitor, mitochondrial
  ENSP ID: ENSP00000489162
MFCHLRPMRRLCLEKIFPHWFPFSRALSGAEAVNALRPFYFAVHPDFFGQHPVEREINENSLKRLSVYLENLQKPGFKSLKPTQLTFYVRETDQSSSDGQEPFSTSGLQMEGGRA

SEQ ID NO: 86188 - protein, 244 aa, Homo sapiens
  Payload ID: 17108
  Gene Symbol: TIGIT
  Gene Name: T cell immunoreceptor with Ig and ITIM domains
  Uniprot ID: Q495A1
  ENSP ID: ENSP00000373167
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 86189 - protein, 169 aa, Homo sapiens
  Payload ID: 17108
  Gene Symbol: TIGIT
  Gene Name: T cell immunoreceptor with Ig and ITIM domains
  ENSP ID: ENSP00000418917
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWS

SEQ ID NO: 86190 - protein, 244 aa, Homo sapiens; identical to SEQ ID NO: 86188
  Payload ID: 17108
  Gene Symbol: TIGIT
  Gene Name: T cell immunoreceptor with Ig and ITIM domains
  Uniprot ID: Q495A1
  ENSP ID: ENSP00000419085

SEQ ID NO: 86191 - protein, 163 aa, Homo sapiens
  Payload ID: 17108
  Gene Symbol: TIGIT
  Gene Name: T cell immunoreceptor with Ig and ITIM domains
  ENSP ID: ENSP00000419706
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSA

SEQ ID NO: 86192 - protein, 311 aa, Homo sapiens
  Payload ID: 17108
  Gene Symbol: TIGIT
  Gene Name: T cell immunoreceptor with Ig and ITIM domains
  ENSP ID: ENSP00000420552
MAFLVAHPMQFVYLLTTLCVFNMVFAKLGFSETVFSQRLSFTVLSAVGYFQWQKRPHLLPVGPLGRSMRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 86193 - protein, 141 aa, Homo sapiens
  Payload ID: 17109
  Gene Symbol: TRAC
  Gene Name: T cell receptor alpha constant
  ENSP ID: ENSP00000480116
  MOD_RES (1)..(1): Any amino acid
XIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 86194 - protein, 162 aa, Homo sapiens [sequence omitted]

SEQ ID NO: 86195 - protein, 21 aa, Homo sapiens
  Payload ID: 17110
  Gene Symbol: TRAJ1
  Gene Name: T cell receptor alpha joining 1 (non-functional)
  ENSP ID: ENSP00000452565
  MOD_RES (1)..(1): Any amino acid
XYESITSQLQFGKGTRVSTSP

SEQ ID NO: 86196 - protein, 21 aa, Homo sapiens
  Payload ID: 17111
  Gene Symbol: TRAJ10
  Gene Name: T cell receptor alpha joining 10
  ENSP ID: ENSP00000451066
ILTGGGNKLTFGTGTQLKVEL

SEQ ID NO: 86197 - protein, 20 aa, Homo sapiens
  Payload ID: 17112
  Gene Symbol: TRAJ11
  Gene Name: T cell receptor alpha joining 11
  ENSP ID: ENSP00000451806
  MOD_RES (1)..(1): Any amino acid
XNSGYSTLTFGKGTMLLVSP

SEQ ID NO: 86198 - protein, 20 aa, Homo sapiens
  Payload ID: 17113
  Gene Symbol: TRAJ12
  Gene Name: T cell receptor alpha joining 12
  ENSP ID: ENSP00000450522
  MOD_RES (1)..(1): Any amino acid
XMDSSYKLIFGSGTRLLVRP

SEQ ID NO: 86199 - protein, 21 aa, Homo sapiens
  Payload ID: 17114
  Gene Symbol: TRAJ13
  Gene Name: T cell receptor alpha joining 13
  ENSP ID: ENSP00000452484
  MOD_RES (1)..(1): Any amino acid
XNSGGYQKVTFGTGTKLQVIP

SEQ ID NO: 86200 - protein, 17 aa, Homo sapiens
  Payload ID: 17115
  Gene Symbol: TRAJ14
  Gene Name: T cell receptor alpha joining 14
  ENSP ID: ENSP00000450438
IYSTFIFGSGTRLSVKP

SEQ ID NO: 86201 - protein, 20 aa, Homo sapiens
  Payload ID: 17116
  Gene Symbol: TRAJ16
  Gene Name: T cell receptor alpha joining 16
  ENSP ID: ENSP00000450622
  MOD_RES (1)..(1): Any amino acid
XFSDGQKLLFARGTMLKVDL

SEQ ID NO: 86202 - protein, 21 aa, Homo sapiens
  Payload ID: 17117
  Gene Symbol: TRAJ17
  Gene Name: T cell receptor alpha joining 17
  ENSP ID: ENSP00000451250
  MOD_RES (1)..(1): Any amino acid
XIKAAGNKLTFGGGTRVLVKP

SEQ ID NO: 86203 - protein, 22 aa, Homo sapiens
  Payload ID: 17118
  Gene Symbol: TRAJ18
  Gene Name: T cell receptor alpha joining 18
  ENSP ID: ENSP00000451639
  MOD_RES (1)..(1): Any amino acid
XDRGSTLGRLYFGRGTQLTVWP

SEQ ID NO: 86204 - protein, 20 aa, Homo sapiens
  Payload ID: 17119
  Gene Symbol: TRAJ19
  Gene Name: T cell receptor alpha joining 19 (non-functional)
  ENSP ID: ENSP00000451728
  MOD_RES (1)..(1): Any amino acid
XYQRFYNFTFGKGSKHNVTP

SEQ ID NO: 86205 - protein, 22 aa, Homo sapiens
  Payload ID: 17120
  Gene Symbol: TRAJ2
  Gene Name: T cell receptor alpha joining 2 (non-functional)
  ENSP ID: ENSP00000450593
  MOD_RES (1)..(1): Any amino acid
XNTGGTIDKLTFGKGTHVFIIS

SEQ ID NO: 86206 - protein, 19 aa, Homo sapiens
  Payload ID: 17121
  Gene Symbol: TRAJ20
  Gene Name: T cell receptor alpha joining 20
  ENSP ID: ENSP00000451847
  MOD_RES (1)..(1): Any amino acid
XSNDYKLSFGAGTTVTVRA

SEQ ID NO: 86207 - protein, 18 aa, Homo sapiens
  Payload ID: 17122
  Gene Symbol: TRAJ21
  Gene Name: T cell receptor alpha joining 21
  ENSP ID: ENSP00000450760
YNFNKFYFGSGTKLNVKP

SEQ ID NO: 86208 - protein, 21 aa, Homo sapiens
  Payload ID: 17123
  Gene Symbol: TRAJ22
  Gene Name: T cell receptor alpha joining 22
  ENSP ID: ENSP00000451843
  MOD_RES (1)..(1): Any amino acid
XSSGSARQLTFGSGTQLTVLP

SEQ ID NO: 86209 - protein, 21 aa, Homo sapiens
  Payload ID: 17124
  Gene Symbol: TRAJ23
  Gene Name: T cell receptor alpha joining 23
  ENSP ID: ENSP00000450455
  MOD_RES (1)..(1): Any amino acid
XIYNQGGKLIFGQGTELSVKP

SEQ ID NO: 86210 - protein, 21 aa, Homo sapiens
  Payload ID: 17125
  Gene Symbol: TRAJ24
  Gene Name: T cell receptor alpha joining 24
  ENSP ID: ENSP00000452134
  MOD_RES (1)..(1): Any amino acid
XTTDSWGKFQFGAGTQVVVTP

SEQ ID NO: 86211 - protein, 20 aa, Homo sapiens
  Payload ID: 17126
  Gene Symbol: TRAJ25
  Gene Name: T cell receptor alpha joining 25 (non-functional)
  ENSP ID: ENSP00000452115
  MOD_RES (1)..(1): Any amino acid
XEGQGFSFIFGKGTRLLVKP

SEQ ID NO: 86212 - protein, 20 aa, Homo sapiens
  Payload ID: 17127
  Gene Symbol: TRAJ26
  Gene Name: T cell receptor alpha joining 26
  ENSP ID: ENSP00000450953
  MOD_RES (1)..(1): Any amino acid
XDNYGQNFVFGPGTRLSVLP

SEQ ID NO: 86213 - protein, 20 aa, Homo sapiens
  Payload ID: 17128
  Gene Symbol: TRAJ27
  Gene Name: T cell receptor alpha joining 27
  ENSP ID: ENSP00000451221
  MOD_RES (1)..(1): Any amino acid
XNTNAGKSTFGDGTTLTVKP

SEQ ID NO: 86214 - protein, 22 aa, Homo sapiens
  Payload ID: 17129
  Gene Symbol: TRAJ28
  Gene Name: T cell receptor alpha joining 28
  ENSP ID: ENSP00000451561
  MOD_RES (1)..(1): Any amino acid
XYSGAGSYQLTFGKGTKLSVIP

SEQ ID NO: 86215 - protein, 20 aa, Homo sapiens
  Payload ID: 17130
  Gene Symbol: TRAJ29
  Gene Name: T cell receptor alpha joining 29
  ENSP ID: ENSP00000452518
  MOD_RES (1)..(1): Any amino acid
XNSGNTPLVFGKGTRLSVIA

SEQ ID NO: 86216 - protein, 21 aa, Homo sapiens
  Payload ID: 17131
  Gene Symbol: TRAJ3
  Gene Name: T cell receptor alpha joining 3
  ENSP ID: ENSP00000451699
  MOD_RES (1)..(1): Any amino acid
XGYSSASKIIFGSGTRLSIRP

SEQ ID NO: 86217 - protein, 19 aa, Homo sapiens
  Payload ID: 17132
  Gene Symbol: TRAJ30
  Gene Name: T cell receptor alpha joining 30
  ENSP ID: ENSP00000451671
  MOD_RES (1)..(1): Any amino acid
XNRDDKIIFGKGTRLHILP

SEQ ID NO: 86218 - protein, 19 aa, Homo sapiens
  Payload ID: 17133
  Gene Symbol: TRAJ31
  Gene Name: T cell receptor alpha joining 31
  ENSP ID: ENSP00000452141
  MOD_RES (1)..(1): Any amino acid
XNNNARLMFGDGTQLVVKP

SEQ ID NO: 86219 - protein, 22 aa, Homo sapiens
  Payload ID: 17134
  Gene Symbol: TRAJ32
  Gene Name: T cell receptor alpha joining 32
  ENSP ID: ENSP00000451503
  MOD_RES (1)..(1): Any amino acid
XNYGGATNKLIFGTGTLLAVQP

SEQ ID NO: 86220 - protein, 19 aa, Homo sapiens
  Payload ID: 17135
  Gene Symbol: TRAJ33
  Gene Name: T cell receptor alpha joining 33
  ENSP ID: ENSP00000451175
  MOD_RES (1)..(1): Any amino acid
XDSNYQLIWGAGTKLIIKP

SEQ ID NO: 86221 - protein, 19 aa, Homo sapiens
  Payload ID: 17136
  Gene Symbol: TRAJ34
  Gene Name: T cell receptor alpha joining 34
  ENSP ID: ENSP00000450793
SYNTDKLIFGTGTRLQVFP

SEQ ID NO: 86222 - protein, 20 aa, Homo sapiens
  Payload ID: 17137
  Gene Symbol: TRAJ35
  Gene Name: T cell receptor alpha joining 35 (non-functional)
  ENSP ID: ENSP00000451687
  MOD_RES (1)..(1): Any amino acid
XIGFGNVLHCGSGTQVIVLP

SEQ ID NO: 86223 - protein, 20 aa, Homo sapiens
  Payload ID: 17138
  Gene Symbol: TRAJ36
  Gene Name: T cell receptor alpha joining 36
  ENSP ID: ENSP00000478270
  MOD_RES (1)..(1): Any amino acid
XQTGANNLFFGTGTRLTVIP

SEQ ID NO: 86224 - protein, 22 aa, Homo sapiens
  Payload ID: 17139
  Gene Symbol: TRAJ37
  Gene Name: T cell receptor alpha joining 37
  ENSP ID: ENSP00000483197
  MOD_RES (1)..(1): Any amino acid
XGSSNTGKLIFGQGTTLQVKPG

SEQ ID NO: 86225 - protein, 21 aa, Homo sapiens
  Payload ID: 17140
  Gene Symbol: TRAJ38
  Gene Name: T cell receptor alpha joining 38
  ENSP ID: ENSP00000451248
  MOD_RES (1)..(1): Any amino acid
XNAGNNRKLIWGLGTSLAVNP

SEQ ID NO: 86226 - protein, 21 aa, Homo sapiens
  Payload ID: 17141
  Gene Symbol: TRAJ39
  Gene Name: T cell receptor alpha joining 39
  ENSP ID: ENSP00000452510
  MOD_RES (1)..(1): Any amino acid
XNNNAGNMLTFGGGTRLMVKP

SEQ ID NO: 86227 - protein, 21 aa, Homo sapiens
  Payload ID: 17142
  Gene Symbol: TRAJ4
  Gene Name: T cell receptor alpha joining 4
  ENSP ID: ENSP00000452097
  MOD_RES (1)..(1): Any amino acid
XFSGGYNKLIFGAGTRLAVHP

SEQ ID NO: 86228 - protein, 20 aa, Homo sapiens
  Payload ID: 17143
  Gene Symbol: TRAJ40
  Gene Name: T cell receptor alpha joining 40
  ENSP ID: ENSP00000452114
TTSGTYKYIFGTGTRLKVLA

SEQ ID NO: 86229 - protein, 21 aa, Homo sapiens
  Payload ID: 17144
  Gene Symbol: TRAJ41
  Gene Name: T cell receptor alpha joining 41
  ENSP ID: ENSP00000452149
  MOD_RES (1)..(1): Any amino acid
XNSNSGYALNFGKGTSLLVTP

SEQ ID NO: 86230 - protein, 22 aa, Homo sapiens
  Payload ID: 17145
  Gene Symbol: TRAJ42
  Gene Name: T cell receptor alpha joining 42
  ENSP ID: ENSP00000451815
  MOD_RES (1)..(1): Any amino acid
XNYGGSQGNLIFGKGTKLSVKP

SEQ ID NO: 86231 - protein, 18 aa, Homo sapiens
  Payload ID: 17146
  Gene Symbol: TRAJ43
  Gene Name: T cell receptor alpha joining 43
  ENSP ID: ENSP00000450690
  MOD_RES (1)..(1): Any amino acid
XNNNDMRFGAGTRLTVKP

SEQ ID NO: 86232 - protein, 21 aa, Homo sapiens
  Payload ID: 17147
  Gene Symbol: TRAJ44
  Gene Name: T cell receptor alpha joining 44
  ENSP ID: ENSP00000451632
  MOD_RES (1)..(1): Any amino acid
XNTGTASKLTFGTGTRLQVTL

SEQ ID NO: 86233 - protein, 22 aa, Homo sapiens
  Payload ID: 17148
  Gene Symbol: TRAJ45
  Gene Name: T cell receptor alpha joining 45
  ENSP ID: ENSP00000451312
  MOD_RES (1)..(1): Any amino acid
XYSGGGADGLTFGKGTHLIIQP

SEQ ID NO: 86234 - protein, 21 aa, Homo sapiens
  Payload ID: 17149
  Gene Symbol: TRAJ46
  Gene Name: T cell receptor alpha joining 46
  ENSP ID: ENSP00000451191
  MOD_RES (1)..(1): Any amino acid
XKKSSGDKLTFGTGTRLAVRP

SEQ ID NO: 86235 - protein, 19 aa, Homo sapiens
  Payload ID: 17150
  Gene Symbol: TRAJ47
  Gene Name: T cell receptor alpha joining 47
  ENSP ID: ENSP00000451749
  MOD_RES (1)..(1): Any amino acid
XEYGNKLVFGAGTILRVKS

SEQ ID NO: 86236 - protein, 21 aa, Homo sapiens
  Payload ID: 17151
  Gene Symbol: TRAJ48
  Gene Name: T cell receptor alpha joining 48
  ENSP ID: ENSP00000450777
  MOD_RES (1)..(1): Any amino acid
XSNFGNEKLTFGTGTRLTIIP

SEQ ID NO: 86237 - protein, 19 aa, Homo sapiens
  Payload ID: 17152
  Gene Symbol: TRAJ49
  Gene Name: T cell receptor alpha joining 49
  ENSP ID: ENSP00000451657
  MOD_RES (1)..(1): Any amino acid
XNTGNQFYFGTGTSLTVIP

SEQ ID NO: 86238 - protein, 20 aa, Homo sapiens
  Payload ID: 17153
  Gene Symbol: TRAJ5
  Gene Name: T cell receptor alpha joining 5
  ENSP ID: ENSP00000450961
  MOD_RES (1)..(1): Any amino acid
XDTGRRALTFGSGTRLQVQP

SEQ ID NO: 86239 - protein, 20 aa, Homo sapiens
  Payload ID: 17154
  Gene Symbol: TRAJ50
  Gene Name: T cell receptor alpha joining 50
  ENSP ID: ENSP00000451589
  MOD_RES (1)..(1): Any amino acid
XKTSYDKVIFGPGTSLSVIP

SEQ ID NO: 86240 - protein, 23 aa, Homo sapiens
  Payload ID: 17155
  Gene Symbol: TRAJ52
  Gene Name: T cell receptor alpha joining 52
  ENSP ID: ENSP00000451143
  MOD_RES (1)..(1): Any amino acid
XNAGGTSYGKLTFGQGTILTVHP

SEQ ID NO: 86241 - protein, 22 aa, Homo sapiens
  Payload ID: 17156
  Gene Symbol: TRAJ53
  Gene Name: T cell receptor alpha joining 53
  ENSP ID: ENSP00000451299
  MOD_RES (1)..(1): Any amino acid
XNSGGSNYKLTFGKGTLLTVNP

SEQ ID NO: 86242 - protein, 20 aa, Homo sapiens
  Payload ID: 17157
  Gene Symbol: TRAJ54
  Gene Name: T cell receptor alpha joining 54
  ENSP ID: ENSP00000452564
  MOD_RES (1)..(1): Any amino acid
XIQGAQKLVFGQGTRLTINP

SEQ ID NO: 86243 - protein, 21 aa, Homo sapiens
  Payload ID: 17158
  Gene Symbol: TRAJ56
  Gene Name: T cell receptor alpha joining 56
  ENSP ID: ENSP00000451870
  MOD_RES (1)..(1): Any amino acid
XYTGANSKLTFGKGITLSVRP

SEQ ID NO: 86244 - protein, 21 aa, Homo sapiens
  Payload ID: 17159
  Gene Symbol: TRAJ57
  Gene Name: T cell receptor alpha joining 57
  ENSP ID: ENSP00000452248
  MOD_RES (1)..(1): Any amino acid
XTQGGSEKLVFGKGTKLTVNP

SEQ ID NO: 86245 - protein, 20 aa, Homo sapiens
  Payload ID: 17160
  Gene Symbol: TRAJ58
  Gene Name: T cell receptor alpha joining 58 (non-functional)
  ENSP ID: ENSP00000452150
  MOD_RES (1)..(1): Any amino acid
XETSGSRLTFGEGTQLTVNP

SEQ ID NO: 86246 - protein, 18 aa, Homo sapiens
  Payload ID: 17161
  Gene Symbol: TRAJ59
  Gene Name: T cell receptor alpha joining 59 (non-functional)
  ENSP ID: ENSP00000451065
  MOD_RES (1)..(1): Any amino acid
XKEGNRKFTFGMGTQVRV

SEQ ID NO: 86247 - protein, 21 aa, Homo sapiens
  Payload ID: 17162
  Gene Symbol: TRAJ6
  Gene Name: T cell receptor alpha joining 6
  ENSP ID: ENSP00000451965
  MOD_RES (1)..(1): Any amino acid
XASGGSYIPTFGRGTSLIVHP

SEQ ID NO: 86248 - protein, 20 aa, Homo sapiens
  Payload ID: 17163
  Gene Symbol: TRAJ61
  Gene Name: T cell receptor alpha joining 61 (non-functional)
  ENSP ID: ENSP00000452464
  MOD_RES (1)..(1): Any amino acid
XYRVNRKLTFGANTRGIMKL

SEQ ID NO: 86249 - protein, 20 aa, Homo sapiens
  Payload ID: 17164
  Gene Symbol: TRAJ7
  Gene Name: T cell receptor alpha joining 7
  ENSP ID: ENSP00000452600
  MOD_RES (1)..(1): Any amino acid
XDYGNNRLAFGKGNQVVVIP

SEQ ID NO: 86250 - protein, 20 aa, Homo sapiens
  Payload ID: 17165
  Gene Symbol: TRAJ9
  Gene Name: T cell receptor alpha joining 9
  ENSP ID: ENSP00000451766
GNTGGFKTIFGAGTRLFVKA

SEQ ID NO: 86251 - protein, 114 aa, Homo sapiens
  Payload ID: 17166
  Gene Symbol: TRAV10
  Gene Name: T cell receptor alpha variable 10
  ENSP ID: ENSP00000440313
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVS

SEQ ID NO: 86252 - protein, 108 aa, Homo sapiens
  Payload ID: 17167
  Gene Symbol: TRAV1-1
  Gene Name: T cell receptor alpha variable 1-1
  ENSP ID: ENSP00000446309
MWGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCAVR

SEQ ID NO: 86253 - protein, 106 aa, Homo sapiens
  Payload ID: 17168
  Gene Symbol: TRAV1-2
  Gene Name: T cell receptor alpha variable 1-2
  ENSP ID: ENSP00000439668
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCA

SEQ ID NO: 86254 - protein, 112 aa, Homo sapiens
  Payload ID: 17169
  Gene Symbol: TRAV12-1
  Gene Name: T cell receptor alpha variable 12-1
  ENSP ID: ENSP00000445405
MISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVN

SEQ ID NO: 86255 - protein, 113 aa, Homo sapiens
  Payload ID: 17170
  Gene Symbol: TRAV12-2
  Gene Name: T cell receptor alpha variable 12-2
  ENSP ID: ENSP00000437362
MKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVN

SEQ ID NO: 86256 - protein, 114 aa, Homo sapiens
  Payload ID: 17171
  Gene Symbol: TRAV12-3
  Gene Name: T cell receptor alpha variable 12-3
  ENSP ID: ENSP00000451822
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMS

SEQ ID NO: 86257 - protein, 112 aa, Homo sapiens
  Payload ID: 17172
  Gene Symbol: TRAV13-1
  Gene Name: T cell receptor alpha variable 13-1
  ENSP ID: ENSP00000441696
MTSIRAVFIFLWLQLDLVNGENVEQHPSTLSVQEGDSAVIKCTYSDSASNYFPWYKQELGKGPQLIIDIRSNVGEKKDQRIAVTLNKTAKHFSLHITETQPEDSAVYFCAAS

SEQ ID NO: 86258 - protein, 113 aa, Homo sapiens
  Payload ID: 17173
  Gene Symbol: TRAV13-2
  Gene Name: T cell receptor alpha variable 13-2
  ENSP ID: ENSP00000438480
MAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAEN

SEQ ID NO: 86259 - protein, 116 aa, Homo sapiens
  Payload ID: 17174
  Gene Symbol: TRAV14DV4
  Gene Name: T cell receptor alpha variable 14/delta variable 4
  ENSP ID: ENSP00000446015
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRE

SEQ ID NO: 86260 - protein, 109 aa, Homo sapiens
  Payload ID: 17175
  Gene Symbol: TRAV16
  Gene Name: T cell receptor alpha variable 16
  ENSP ID: ENSP00000451359
MKPTLISVLVIIFILRGTRAQRVTQPEKLLSVFKGAPVELKCNYSYSGSPELFWYVQYSRQRLQLLLRHISRESIKGFTADLNKGETSFHLKKPFAQEEDSAMYYCALS

SEQ ID NO: 86261 - protein, 112 aa, Homo sapiens
  Payload ID: 17176
  Gene Symbol: TRAV17
  Gene Name: T cell receptor alpha variable 17
  ENSP ID: ENSP00000452087
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATD

SEQ ID NO: 86262 - protein, 111 aa, Homo sapiens
  Payload ID: 17177
  Gene Symbol: TRAV18
  Gene Name: T cell receptor alpha variable 18
  ENSP ID: ENSP00000451574
MLSASCSGLVILLIFRRTSGDSVTQTEGPVTLPERAALTLNCTYQSSYSTFLFWYVQYLNKEPELLLKSSENQETDSRGFQASPIKSDSSFHLEKPSVQLSDSAVYYCALR

SEQ ID NO: 86263 - protein, 116 aa, Homo sapiens
  Payload ID: 17178
  Gene Symbol: TRAV19
  Gene Name: T cell receptor alpha variable 19
  ENSP ID: ENSP00000452148
MLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSE

SEQ ID NO: 86264 - protein, 112 aa, Homo sapiens
  Payload ID: 17179
  Gene Symbol: TRAV2
  Gene Name: T cell receptor alpha variable 2
  ENSP ID: ENSP00000438195
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVE

SEQ ID NO: 86265 - protein, 112 aa, Homo sapiens
  Payload ID: 17180
  Gene Symbol: TRAV20
  Gene Name: T cell receptor alpha variable 20
  ENSP ID: ENSP00000452067
MEKMLECAFIVLWLQLGWLSGEDQVTQSPEALRLQEGESSSLNCSYTVSGLRGLFWYRQDPGKGPEFLFTLYSAGEEKEKERLKATLTKKESFLHITAPKPEDSATYLCAVQ

SEQ ID NO: 86266 - protein, 112 aa, Homo sapiens
  Payload ID: 17181
  Gene Symbol: TRAV21
  Gene Name: T cell receptor alpha variable 21
  ENSP ID: ENSP00000452526
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVR

SEQ ID NO: 86267 - protein, 110 aa, Homo sapiens
  Payload ID: 17182
  Gene Symbol: TRAV22
  Gene Name: T cell receptor alpha variable 22
  ENSP ID: ENSP00000452420
MKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVE

SEQ ID NO: 86268 - protein, 121 aa, Homo sapiens
  Payload ID: 17183
  Gene Symbol: TRAV23DV6
  Gene Name: T cell receptor alpha variable 23/delta variable 6
  ENSP ID: ENSP00000451203
MDKILGASFLVLWLQLCWVSGQQKEKSDQQQVKQSPQSLIVQKGGISIINCAYENTAFDYFPWYQQFPGKGPALLIAIRPDVSEKKEGRFTISFNKSAKQFSSHIMDSQPGDSATYFCAAS

SEQ ID NO: 86269 - protein, 114 aa, Homo sapiens
  Payload ID: 17184
  Gene Symbol: TRAV24
  Gene Name: T cell receptor alpha variable 24
  ENSP ID: ENSP00000451837
MEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCAF

SEQ ID NO: 86270 - protein, 109 aa, Homo sapiens
  Payload ID: 17185
  Gene Symbol: TRAV25
  Gene Name: T cell receptor alpha variable 25
  ENSP ID: ENSP00000452100
MLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAG

SEQ ID NO: 86271 - protein, 109 aa, Homo sapiens
  Payload ID: 17186
  Gene Symbol: TRAV26-1
  Gene Name: T cell receptor alpha variable 26-1
  ENSP ID: ENSP00000452431
MRLVARVTVFLTFGTIIDAKTTQPTSMDCAEGRAANLPCNHSTISGNEYVYWYRQIHSQGPQYIIHGLKNNETNEMASLIITEDRKSSTLILPHATLRDTAVYYCIVRV

SEQ ID NO: 86272 - protein, 109 aa, Homo sapiens
  Payload ID: 17187
  Gene Symbol: TRAV26-2
  Gene Name: T cell receptor alpha variable 26-2
  ENSP ID: ENSP00000450970
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRD

SEQ ID NO: 86273 - protein, 109 aa, Homo sapiens
  Payload ID: 17188
  Gene Symbol: TRAV27
  Gene Name: T cell receptor alpha variable 27
  ENSP ID: ENSP00000451735
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQTGDTGLYLCAG

SEQ ID NO: 86274 - protein, 119 aa, Homo sapiens
  Payload ID: 17189
  Gene Symbol: TRAV29DV5
  Gene Name: T cell receptor alpha variable 29/delta variable 5 (gene/pseudogene)
  ENSP ID: ENSP00000452209
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAAS

SEQ ID NO: 86275 - protein, 114 aa, Homo sapiens
  Payload ID: 17190
  Gene Symbol: TRAV3
  Gene Name: T cell receptor alpha variable 3 (gene/pseudogene)
  ENSP ID: ENSP00000444955
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRD

SEQ ID NO: 86276 - protein, 112 aa, Homo sapiens
  Payload ID: 17191
  Gene Symbol: TRAV30
  Gene Name: T cell receptor alpha variable 30
  ENSP ID: ENSP00000451308
METLLKVLSGTLLWQLTWVRSQQPVQSPQAVILREGEDAVINCSSSKALYSVHWYRQKHGEAPVFLMILLKGGEQKGHDKISASFNEKKQQSSLYLTASQLSYSGTYFCGTE

SEQ ID NO: 86277 - protein, 112 aa, Homo sapiens
  Payload ID: 17192
  Gene Symbol: TRAV34
  Gene Name: T cell receptor alpha variable 34
  ENSP ID: ENSP00000452002
METVLQVLLGILGFQAAWVSSQELEQSPQSLIVQEGKNLTINCTSSKTLYGLYWYKQKYGEGLIFLMMLQKGGEEKSHEKITAKLDEKKQQSSLHITASQPSHAGIYLCGAD

SEQ ID NO: 86278 - protein, 113 aa, Homo sapiens
  Payload ID: 17193
  Gene Symbol: TRAV36DV7
  Gene Name: T cell receptor alpha variable 36/delta variable 7
  ENSP ID: ENSP00000450804
MMKCPQALLAIFWLLLSWVSSEDKVVQSPLSLVVHEGDTVTLNCSYEVTNFRSLLWYKQEKKAPTFLFMLTSSGIEKKSGRLSSILDKKELFSILNITATQTGDSAIYLCAVE

SEQ ID NO: 86279 - protein, 116 aa, Homo sapiens
  Payload ID: 17194
  Gene Symbol: TRAV38-1
  Gene Name: T cell receptor alpha variable 38-1
  ENSP ID: ENSP00000450950
MTRVSLLWAVVVSTCLESGMAQTVTQSQPEMSVQEAETVTLSCTYDTSENNYYLFWYKQPPSRQMILVIRQEAYKQQNATENRFSVNFQKAAKSFSLKISDSQLGDTAMYFCAFMK

SEQ ID NO: 86280 - protein, 116 aa, Homo sapiens
  Payload ID: 17195
  Gene Symbol: TRAV38-2DV8
  Gene Name: T cell receptor alpha variable 38-2/delta variable 8
  ENSP ID: ENSP00000452332
MACPGFLWALVISTCLEFSMAQTVTQSQPEMSVQEAETVTLSCTYDTSESDYYLFWYKQPPSRQMILVIRQEAYKQQNATENRFSVNFQKAAKSFSLKISDSQLGDAAMYFCAYRS

SEQ ID NO: 86281 - protein, 110 aa, Homo sapiens
  Payload ID: 17196
  Gene Symbol: TRAV39
  Gene Name: T cell receptor alpha variable 39
  ENSP ID: ENSP00000450865
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVD

SEQ ID NO: 86282 - protein, 109 aa, Homo sapiens
  Payload ID: 17197
  Gene Symbol: TRAV4
  Gene Name: T cell receptor alpha variable 4
  ENSP ID: ENSP00000451535
MRQVARVIVFLTLSTLSLAKTTQPISMDSYEGQEVNITCSHNNIATNDYITWYQQFPSQGPRFIIQGYKTKVTNEVASLFIPADRKSSTLSLPRVSLSDTAVYYCLVGD

SEQ ID NO: 86283 - protein, 105 aa, Homo sapiens
  Payload ID: 17198
  Gene Symbol: TRAV40
  Gene Name: T cell receptor alpha variable 40
  ENSP ID: ENSP00000452585
MNSSLDFLILILMFGGTSSNSVKQTGQITVSEGASVTMNCTYTSTGYPTLFWYVEYPSKPLQLLQRETMENSKNFGGGNIKDKNSPIVKYSVQVSDSAVYYCLLG

SEQ ID NO: 86284 - protein, 112 aa, Homo sapiens
  Payload ID: 17199
  Gene Symbol: TRAV41
  Gene Name: T cell receptor alpha variable 41
  ENSP ID: ENSP00000451177
MVKIRQFLLAILWLQLSCVSAAKNEVEQSPQNLTAQEGEFITINCSYSVGISALHWLQQHPGGGIVSLFMLSSGKKKHGRLIATINIQEKHSSLHITASHPRDSAVYICAVR

SEQ ID NO: 86285 - protein, 113 aa, Homo sapiens
  Payload ID: 17200
  Gene Symbol: TRAV5
  Gene Name: T cell receptor alpha variable 5
  ENSP ID: ENSP00000446355
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAES

SEQ ID NO: 86286 - protein, 132 aa, Homo sapiens
  Payload ID: 17201
  Gene Symbol: TRAV6
  Gene Name: T cell receptor alpha variable 6
  ENSP ID: ENSP00000438290
MAFWLRSLGLHFRPHLGRRMESFLGGVLLILWLQVDWVKSQKIEQNSEALNIQEGKTATLTCNYTNYSPAYLQWYRQDPGRGPVFLLLIRENEKEKRKERLKVTFDTTLKQSLFHITASQPADSATYLCALD

SEQ ID NO: 86287 - protein, 112 aa, Homo sapiens
  Payload ID: 17202
  Gene Symbol: TRAV7
  Gene Name: T cell receptor alpha variable 7
  ENSP ID: ENSP00000443297
MEKMRRPVLIIFCLCLGWANGENQVEHSPHFLGPQQGDVASMSCTYSVSRFNNLQWYRQNTGMGPKHLLSMYSAGYEKQKGRLNATLLKNGSSLYITAVQPEDSATYFCAVD

SEQ ID NO: 86288 - protein, 113 aa, Homo sapiens
  Payload ID: 17203
  Gene Symbol: TRAV8-1
  Gene Name: T cell receptor alpha variable 8-1
  ENSP ID: ENSP00000443059
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVN

SEQ ID NO: 86289 - protein, 113 aa, Homo sapiens
  Payload ID: 17204
  Gene Symbol: TRAV8-2
  Gene Name: T cell receptor alpha variable 8-2
  ENSP ID: ENSP00000439323
MLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVS

SEQ ID NO: 86290 - protein, 113 aa, Homo sapiens
  Payload ID: 17205
  Gene Symbol: TRAV8-3
  Gene Name: T cell receptor alpha variable 8-3
  ENSP ID: ENSP00000440087
MLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAVG

SEQ ID NO: 86291 - protein, 113 aa, Homo sapiens
  Payload ID: 17206
  Gene Symbol: TRAV8-4
  Gene Name: T cell receptor alpha variable 8-4
  ENSP ID: ENSP00000445942
MLLLLVPVLEVIFTLGGTRAQSVTQLGSHVSVSEGALVLLRCNYSSSVPPYLFWYVQYPNQGLQLLLKYTSAATLVKGINGFEAEFKKSETSFHLTKPSAHMSDAAEYFCAVS

SEQ ID NO: 86292 - protein, 113 aa, Homo sapiens
  Payload ID: 17207
  Gene Symbol: TRAV8-6
  Gene Name: T cell receptor alpha variable 8-6
  ENSP ID: ENSP00000450505
MLLLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVS

SEQ ID NO: 86293 - protein, 113 aa, Homo sapiens
  Payload ID: 17208
  Gene Symbol: TRAV8-7
  Gene Name: T cell receptor alpha variable 8-7 (non-functional)
  ENSP ID: ENSP00000450448
MLLVVILLLGMFFTLSKTQSVTQLDGHITVSEEAPLELKCNYSYSGVPSLFWYVQYSSQSLQLLLKDLTKATQVKGIRGFEAEFKKSETSFYLRKPSTHVSDAAEYFCAVGDR

SEQ ID NO: 86294 - protein, 112 aa, Homo sapiens
  Payload ID: 17209
  Gene Symbol: TRAV9-1
  Gene Name: T cell receptor alpha variable 9-1
  ENSP ID: ENSP00000438446
MNSSPGPAIALFLMFGGINGDSVVQTEGQVLPSEGDSLIVNCSYETTQYPSLFWYVQYPGEGPQLHLKAMKANDKGRNKGFEAMYRKETTSFHLEKDSVQESDSAVYFCALS

SEQ ID NO: 86295 - protein, 112 aa, Homo sapiens
  Payload ID: 17210
  Gene Symbol: TRAV9-2
  Gene Name: T cell receptor alpha variable 9-2
  ENSP ID: ENSP00000452011
MNYSPGLVSLILLLLGRTRGDSVTQMEGPVTLSEEAFLTINCTYTATGYPSLFWYVQYPGEGLQLLLKATKADDKGSNKGFEATYRKETTSFHLEKGSVQVSDSAVYFCALS

SEQ ID NO: 86296 - protein, 186 aa, Homo sapiens
  Payload ID: 17211
  Gene Symbol: TRAT1
  Gene Name: T cell receptor associated transmembrane adaptor 1
  Uniprot ID: Q6PIZ9
  ENSP ID: ENSP00000295756
MSGISGCPFFLWGLLALLGLALVISLIFNISHYVEKQRQDKMYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 86297 - protein, 149 aa, Homo sapiens
  Payload ID: 17211
  Gene Symbol: TRAT1
  Gene Name: T cell receptor associated transmembrane adaptor 1
  ENSP ID: ENSP00000410097
MSDKMYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 86298 - protein, 309 aa, Homo sapiens
  Payload ID: 17212
  Gene Symbol: TRBC1
  Gene Name: T cell receptor beta constant 1
  ENSP ID: ENSP00000480758
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLCTAQHSCILCSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 86299 - protein, 309 aa, Homo sapiens
  Payload ID: 17212
  Gene Symbol: TRBC1
  Gene Name: T cell receptor beta constant 1
  ENSP ID: ENSP00000482915
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLCTAQHSRILCSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 86300 - protein, 310 aa, Homo sapiens
  Payload ID: 17212
  Gene Symbol: TRBC1
  Gene Name: T cell receptor beta constant 1
  ENSP ID: ENSP00000483538
MTIRLLCYMGFYFLGAGLMEADIYQTPRYLVIGTGKKITLECSQTMGHDKMYWYQQDPGMELHLIYFSYDVKMKEKGDIPEGYSVSREKKERFSLILESASTNQTSMYLCASSMHSAAASSLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 86301 - protein, 177 aa, Homo sapiens
  Payload ID: 17212
  Gene Symbol: TRBC1
  Gene Name: T cell receptor beta constant 1
  ENSP ID: ENSP00000487742
  MOD_RES (1)..(1): Any amino acid
XDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 86302 - protein, 177 aa, Homo sapiens; identical to SEQ ID NO: 86301
  Payload ID: 17212
  Gene Symbol: TRBC1
  Gene Name: T cell receptor beta constant 1
  ENSP ID: ENSP00000488819
  MOD_RES (1)..(1): Any amino acid

SEQ ID NO: 86303 - protein, 179 aa, Homo sapiens
  Payload ID: 17213
  Gene Symbol: TRBC2
  Gene Name: T cell receptor beta constant 2
  ENSP ID: ENSP00000417300
  MOD_RES (1)..(1): Any amino acid
XDLKNVFPPKVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 86304 - protein, 310 aa, Homo sapiens
  Payload ID: 17213
  Gene Symbol: TRBC2
  Gene Name: T cell receptor beta constant 2
  ENSP ID: ENSP00000478607
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSIDTDEQYVGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 86305 - protein, 311 aa, Homo sapiens
  Payload ID: 17213
  Gene Symbol: TRBC2
  Gene Name: T cell receptor beta constant 2
  ENSP ID: ENSP00000478854
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSLSTVLHSQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 86306 - protein, 179 aa, Homo sapiens
  Payload ID: 17213
  Gene Symbol: TRBC2
  Gene Name: T cell receptor beta constant 2
  ENSP ID: ENSP00000478873
  MOD_RES (1)..(1): Any amino acid
XDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 86307 - protein, 314 aa, Homo sapiens
  Payload ID: 17213
  Gene Symbol: TRBC2
  Gene Name: T cell receptor beta constant 2
  ENSP ID: ENSP00000479209
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSEWLGGRDQETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 86308 - protein, 315 aa, Homo sapiens
  Payload ID: 17213
  Gene Symbol: TRBC2
  Gene Name: T cell receptor beta constant 2
  ENSP ID: ENSP00000481359
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSEAQYRSPSYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 86309 - protein, 313 aa, Homo sapiens
  Payload ID: 17213
  Gene Symbol: TRBC2
  Gene Name: T cell receptor beta constant 2
  ENSP ID: ENSP00000482687
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSSPLCSGANVLTFGAGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 86310 - protein, 4 aa, Homo sapiens
  Payload ID: 17214
  Gene Symbol: TRBD1
  Gene Name: T cell receptor beta diversity 1
  ENSP ID: ENSP00000487941
GTGG

SEQ ID NO: 86311 - protein, 4 aa, Homo sapiens
  Payload ID: 17214
  Gene Symbol: TRBD1
  Gene Name: T cell receptor beta diversity 1
  ENSP ID: ENSP00000488240
GTGG

SEQ ID NO: 86312 - protein, 16 aa, Homo sapiens
  Payload ID: 17215
  Gene Symbol: TRBJ1-1
  Gene Name: T cell receptor beta joining 1-1
  ENSP ID: ENSP00000488318
  MOD_RES (1)..(1): Any amino acid
XNTEAFFGQGTRLTVV

SEQ ID NO: 86313 - protein, 16 aa, Homo sapiens
  Payload ID: 17215
  Gene Symbol: TRBJ1-1
  Gene Name: T cell receptor beta joining 1-1
  ENSP ID: ENSP00000488686
  MOD_RES (1)..(1): Any amino acid
XNTEAFFGQGTRLTVV

SEQ ID NO: 86314 - protein, 16 aa, Homo sapiens
  Payload ID: 17216
  Gene Symbol: TRBJ1-2
  Gene Name: T cell receptor beta joining 1-2
  ENSP ID: ENSP00000488193
  MOD_RES (1)..(1): Any amino acid
XNYGYTFGSGTRLTVV

SEQ ID NO: 86315 - protein, 16 aa, Homo sapiens
  Payload ID: 17216
  Gene Symbol: TRBJ1-2
  Gene Name: T cell receptor beta joining 1-2
  ENSP ID: ENSP00000488356
  MOD_RES (1)..(1): Any amino acid
XNYGYTFGSGTRLTVV

SEQ ID NO: 86316 - protein, 17 aa, Homo sapiens
  Payload ID: 17217
  Gene Symbol: TRBJ1-3
  Gene Name: T cell receptor beta joining 1-3
  ENSP ID: ENSP00000488060
  MOD_RES (1)..(1): Any amino acid
XSGNTIYFGEGSWLTVV

SEQ ID NO: 86317 - protein, 17 aa, Homo sapiens
  Payload ID: 17217
  Gene Symbol: TRBJ1-3
  Gene Name: T cell receptor beta joining 1-3
  ENSP ID: ENSP00000488093
  MOD_RES (1)..(1): Any amino acid
XSGNTIYFGEGSWLTVV

SEQ ID NO: 86318 - protein, 17 aa, Homo sapiens
  Payload ID: 17218
  Gene Symbol: TRBJ1-4
  Gene Name: T cell receptor beta joining 1-4
  ENSP ID: ENSP00000488040
  MOD_RES (1)..(1): Any amino acid
XTNEKLFFGSGTQLSVL

SEQ ID NO: 86319 - protein, 17 aa, Homo sapiens
  Payload ID: 17218
  Gene Symbol: TRBJ1-4
  Gene Name: T cell receptor beta joining 1-4
  ENSP ID: ENSP00000488394
  MOD_RES (1)..(1): Any amino acid
XTNEKLFFGSGTQLSVL

SEQ ID NO: 86320 - protein, 17 aa, Homo sapiens
  Payload ID: 17219
  Gene Symbol: TRBJ1-5
  Gene Name: T cell receptor beta joining 1-5
  ENSP ID: ENSP00000487943
  MOD_RES (1)..(1): Any amino acid
XSNQPQHFGDGTRLSIL

SEQ ID NO: 86321 - protein, 17 aa, Homo sapiens
  Payload ID: 17219
  Gene Symbol: TRBJ1-5
  Gene Name: T cell receptor beta joining 1-5
  ENSP ID: ENSP00000488469
  MOD_RES (1)..(1): Any amino acid
XSNQPQHFGDGTRLSIL

SEQ ID NO: 86322 - protein, 18 aa, Homo sapiens
  Payload ID: 17220
  Gene Symbol: TRBJ1-6
  Gene Name: T cell receptor beta joining 1-6
  ENSP ID: ENSP00000488155
  MOD_RES (1)..(1): Any amino acid
XSYNSPLHFGNGTRLTVT

SEQ ID NO: 86323 - protein, 18 aa, Homo sapiens
  Payload ID: 17220
  Gene Symbol: TRBJ1-6
  Gene Name: T cell receptor beta joining 1-6
  ENSP ID: ENSP00000488283
  MOD_RES (1)..(1): Any amino acid
XSYNSPLHFGNGTRLTVT

SEQ ID NO: 86324 - protein, 17 aa, Homo sapiens
  Payload ID: 17221
  Gene Symbol: TRBJ2-1
  Gene Name: T cell receptor beta joining 2-1
  ENSP ID: ENSP00000420669
  MOD_RES (1)..(1): Any amino acid
XSYNEQFFGPGTRLTVL

SEQ ID NO: 86325 - protein, 17 aa, Homo sapiens
  Payload ID: 17221
  Gene Symbol: TRBJ2-1
  Gene Name: T cell receptor beta joining 2-1
  ENSP ID: ENSP00000488460
  MOD_RES (1)..(1): Any amino acid
XSYNEQFFGPGTRLTVL

SEQ ID NO: 86326 - protein, 17 aa, Homo sapiens
  Payload ID: 17222
  Gene Symbol: TRBJ2-2
  Gene Name: T cell receptor beta joining 2-2
  ENSP ID: ENSP00000419331
  MOD_RES (1)..(1): Any amino acid
XNTGELFFGEGSRLTVL

SEQ ID NO: 86327 - protein, 17 aa, Homo sapiens
  Payload ID: 17222
  Gene Symbol: TRBJ2-2
  Gene Name: T cell receptor beta joining 2-2
  ENSP ID: ENSP00000488401
  MOD_RES (1)..(1): Any amino acid
XNTGELFFGEGSRLTVL

SEQ ID NO: 86328 - protein, 15 aa, Homo sapiens
  Payload ID: 17223
  Gene Symbol: TRBJ2-2P
  Gene Name: T cell receptor beta joining 2-2P (non-functional)
  ENSP ID: ENSP00000420142
LRGAAGRLGGGLLVL

SEQ ID NO: 86329 - protein, 15 aa, Homo sapiens
  Payload ID: 17223
  Gene Symbol: TRBJ2-2P
  Gene Name: T cell receptor beta joining 2-2P (non-functional)
  ENSP ID: ENSP00000487962
LRGAAGRLGGGLLVL

SEQ ID NO: 86330 - protein, 16 aa, Homo sapiens
  Payload ID: 17224
  Gene Symbol: TRBJ2-3
  Gene Name: T cell receptor beta joining 2-3
  ENSP ID: ENSP00000419595
STDTQYFGPGTRLTVL

SEQ ID NO: 86331 - protein, 16 aa, Homo sapiens
  Payload ID: 17224
  Gene Symbol: TRBJ2-3
  Gene Name: T cell receptor beta joining 2-3
  ENSP ID: ENSP00000488292
STDTQYFGPGTRLTVL

SEQ ID NO: 86332 - protein, 17 aa, Homo sapiens
  Payload ID: 17225
  Gene Symbol: TRBJ2-4
  Gene Name: T cell receptor beta joining 2-4
  ENSP ID: ENSP00000418890
  MOD_RES (1)..(1): Any amino acid
XAKNIQYFGAGTRLSVL

SEQ ID NO: 86333 - protein, 17 aa, Homo sapiens
  Payload ID: 17225
  Gene Symbol: TRBJ2-4
  Gene Name: T cell receptor beta joining 2-4
  ENSP ID: ENSP00000488489
  MOD_RES (1)..(1): Any amino acid
XAKNIQYFGAGTRLSVL

SEQ ID NO: 86334 - protein, 16 aa, Homo sapiens
  Payload ID: 17226
  Gene Symbol: TRBJ2-5
  Gene Name: T cell receptor beta joining 2-5
  ENSP ID: ENSP00000420233
  MOD_RES (1)..(1): Any amino acid
XQETQYFGPGTRLLVL

SEQ ID NO: 86335 - protein, 16 aa, Homo sapiens
  Payload ID: 17226
  Gene Symbol: TRBJ2-5
  Gene Name: T cell receptor beta joining 2-5
  ENSP ID: ENSP00000487747
  MOD_RES (1)..(1): Any amino acid
XQETQYFGPGTRLLVL

SEQ ID NO: 86336 - protein, 18 aa, Homo sapiens
  Payload ID: 17227
  Gene Symbol: TRBJ2-6
  Gene Name: T cell receptor beta joining 2-6
  ENSP ID: ENSP00000417114
  MOD_RES (1)..(1): Any amino acid
XSGANVLTFGAGSRLTVL

SEQ ID NO: 86337 - protein, 18 aa, Homo sapiens
  Payload ID: 17227
  Gene Symbol: TRBJ2-6
  Gene Name: T cell receptor beta joining 2-6
  ENSP ID: ENSP00000488363
  MOD_RES (1)..(1): Any amino acid
XSGANVLTFGAGSRLTVL

SEQ ID NO: 86338 - protein, 16 aa, Homo sapiens
  Payload ID: 17228
  Gene Symbol: TRBJ2-7
  Gene Name: T cell receptor beta joining 2-7
  ENSP ID: ENSP00000417622
  MOD_RES (1)..(1): Any amino acid
XSYEQYFGPGTRLTVT

SEQ ID NO: 86339 - protein, 16 aa, Homo sapiens
  Payload ID: 17228
  Gene Symbol: TRBJ2-7
  Gene Name: T cell receptor beta joining 2-7
  ENSP ID: ENSP00000488028
  MOD_RES (1)..(1): Any amino acid
XSYEQYVGPGTRLTVT

SEQ ID NO: 86340 - protein, 114 aa, Homo sapiens
  Payload ID: 17229
  Gene Symbol: TRBV10-1
  Gene Name: T cell receptor beta variable 10-1(gene/pseudogene)
  ENSP ID: ENSP00000374887
MGTRLFFYVALCLLWAGHRDAEITQSPRHKITETGRQVTLACHQTWNHNNMFWYRQDLGHGLRLIHYSYGVHDTNKGEVSDGYSVSRSNTEDLPLTLESAASSQTSVYFCASSE

SEQ ID NO: 86341 - protein, 114 aa, Homo sapiens; identical to SEQ ID NO: 86340
  Payload ID: 17229
  Gene Symbol: TRBV10-1
  Gene Name: T cell receptor beta variable 10-1(gene/pseudogene)
  ENSP ID: ENSP00000488035

SEQ ID NO: 86342 - protein, 114 aa, Homo sapiens
  Payload ID: 17230
  Gene Symbol: TRBV10-2
  Gene Name: T cell receptor beta variable 10-2
  ENSP ID: ENSP00000404652
MGTRLFFYVALCLLWAGHRDAGITQSPRYKITETGRQVTLMCHQTWSHSYMFWYRQDLGHGLRLIYYSAAADITDKGEVPDGYVVSRSKTENFPLTLESATRSQTSVYFCASSE

SEQ ID NO: 86343 - protein, 114 aa, Homo sapiens; identical to SEQ ID NO: 86342
  Payload ID: 17230
  Gene Symbol: TRBV10-2
  Gene Name: T cell receptor beta variable 10-2
  ENSP ID: ENSP00000488043

SEQ ID NO: 86344 - protein, 114 aa, Homo sapiens
  Payload ID: 17231
  Gene Symbol: TRBV10-3
  Gene Name: T cell receptor beta variable 10-3
  ENSP ID: ENSP00000479267
MGTRLFFYVALCLLWTGHMDAGITQSPRHKVTETGTPVTLRCHQTENHRYMYWYRQDPGHGLRLIHYSYGVKDTDKGEVSDGYSVSRSKTEDFLLTLESATSSQTSVYFCAISE

SEQ ID NO: 86345 - protein, 114 aa, Homo sapiens; identical to SEQ ID NO: 86344
  Payload ID: 17231
  Gene Symbol: TRBV10-3
  Gene Name: T cell receptor beta variable 10-3
  ENSP ID: ENSP00000487891

SEQ ID NO: 86346 - protein, 115 aa, Homo sapiens
  Payload ID: 17232
  Gene Symbol: TRBV11-1
  Gene Name: T cell receptor beta variable 11-1
  ENSP ID: ENSP00000374890
MSTRLLCWMALCLLGAELSEAEVAQSPRYKITEKSQAVAFWCDPISGHATLYWYRQILGQGPELLVQFQDESVVDDSQLPKDRFSAERLKGVDSTLKIQPAELGDSAMYLCASSL

SEQ ID NO: 86347 - protein, 115 aa, Homo sapiens; identical to SEQ ID NO: 86346
  Payload ID: 17232
  Gene Symbol: TRBV11-1
  Gene Name: T cell receptor beta variable 11-1
  ENSP ID: ENSP00000488521

SEQ ID NO: 86348 - protein, 115 aa, Homo sapiens
  Payload ID: 17233
  Gene Symbol: TRBV11-3
  Gene Name: T cell receptor beta variable 11-3
  ENSP ID: ENSP00000480080
MGTRLLCWVAFCLLVEELIEAGVVQSPRYKIIEKKQPVAFWCNPISGHNTLYWYLQNLGQGPELLIRYENEEAVDDSQLPKDRFSAERLKGVDSTLKIQPAELGDSAVYLCASSL

SEQ ID NO: 86349 - protein, 115 aa, Homo sapiens; identical to SEQ ID NO: 86348
  Payload ID: 17233
  Gene Symbol: TRBV11-3
  Gene Name: T cell receptor beta variable 11-3
  ENSP ID: ENSP00000487749

SEQ ID NO: 86350 - protein, 115 aa, Homo sapiens
  Payload ID: 17234
  Gene Symbol: TRBV12-3
  Gene Name: T cell receptor beta variable 12-3
  ENSP ID: ENSP00000477916
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSL

SEQ ID NO: 86351 - protein, 115 aa, Homo sapiens; identical to SEQ ID NO: 86350
  Payload ID: 17234
  Gene Symbol: TRBV12-3
  Gene Name: T cell receptor beta variable 12-3
  ENSP ID: ENSP00000487964

SEQ ID NO: 86352 - protein, 115 aa, Homo sapiens
  Payload ID: 17235
  Gene Symbol: TRBV12-4
  Gene Name: T cell receptor beta variable 12-4
  ENSP ID: ENSP00000480999
MGSWTLCCVSLCILVAKHTDAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSL

SEQ ID NO: 86353 - protein, 115 aa, Homo sapiens
  Payload ID: 17235
  Gene Symbol: TRBV12-4
  Gene Name: T cell receptor beta variable 12-4
  ENSP ID: ENSP00000488855
MDSWTLCCVSLCILVAKHTDAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSL

SEQ ID NO: 86354 - protein, 115 aa, Homo sapiens
  Payload ID: 17236
  Gene Symbol: TRBV12-5
  Gene Name: T cell receptor beta variable 12-5
  ENSP ID: ENSP00000479506
MATRLLCCVVLCLLGEELIDARVTQTPRHKVTEMGQEVTMRCQPILGHNTVFWYRQTMMQGLELLAYFRNRAPLDDSGMPKDRFSAEMPDATLATLKIQPSEPRDSAVYFCASGL

SEQ ID NO: 86355 - protein, 115 aa, Homo sapiens
  Payload ID: 17236
  Gene Symbol: TRBV12-5
  Gene Name: T cell receptor beta variable 12-5
  ENSP ID: ENSP00000488633
MATRLLCCVVLCLLGEELIDARVTQTPRDKVTEMGQEVTMRCQPILGHNTVFWYRQTMMQGLELLAYFRNRAPLDDSGMPKDRFSAEMPDATLATLKIQPSEPRDSAVYFCASGL

SEQ ID NO: 86356 - protein, 124 aa, Homo sapiens
  Payload ID: 17237
  Gene Symbol: TRBV13
  Gene Name: T cell receptor beta variable 13
  ENSP ID: ENSP00000477580
MLSPDLPDSAWNTRLLCRVMLCLLGAGSVAAGVIQSPRHLIKEKRETATLKCYPIPRHDTVYWYQQGPGQDPQFLISFYEKMQSDKGSIPDRFSAQQFSDYHSELNMSSLELGDSALYFCASSL

SEQ ID NO: 86357 - protein, 124 aa, Homo sapiens; identical to SEQ ID NO: 86356
  Payload ID: 17237
  Gene Symbol: TRBV13
  Gene Name: T cell receptor beta variable 13
  ENSP ID: ENSP00000488778

SEQ ID NO: 86358 - protein, 115 aa, Homo sapiens
  Payload ID: 17238
  Gene Symbol: TRBV14
  Gene Name: T cell receptor beta variable 14
  ENSP ID: ENSP00000477671
MVSRLLSLVSLCLLGAKHIEAGVTQFPSHSVIEKGQTVTLRCDPISGHDNLYWYRRVMGKEIKFLLHFVKESKQDESGMPNNRFLAERTGGTYSTLKVQPAELEDSGVYFCASSQ

SEQ ID NO: 86359 - protein, 115 aa, Homo sapiens; identical to SEQ ID NO: 86358
  Payload ID: 17238
  Gene Symbol: TRBV14
  Gene Name: T cell receptor beta variable 14
  ENSP ID: ENSP00000488641

SEQ ID NO: 86360 - protein, 114 aa, Homo sapiens
  Payload ID: 17239
  Gene Symbol: TRBV15
  Gene Name: T cell receptor beta variable 15
  ENSP ID: ENSP00000482333
MGPGLLHWMALCLLGTGHGDAMVIQNPRYQVTQFGKPVTLSCSQTLNHNVMYWYQQKSSQAPKLLFHYYDKDFNNEADTPDNFQSRRPNTSFCFLDIRSPGLGDAAMYLCATSR

SEQ ID NO: 86361 - protein, 114 aa, Homo sapiens; identical to SEQ ID NO: 86360
  Payload ID: 17239
  Gene Symbol: TRBV15
  Gene Name: T cell receptor beta variable 15
  ENSP ID: ENSP00000488551

SEQ ID NO: 86362 - protein, 115 aa, Homo sapiens
  Payload ID: 17240
  Gene Symbol: TRBV16
  Gene Name: T cell receptor beta variable 16 (gene/pseudogene)
  ENSP ID: ENSP00000479210
MSPIFTCITILCLLAAGSPGEEVAQTPKHLVRGEGQKAKLYCAPIKGHSYVFWYQQVLKNEFKFLISFQNENVFDETGMPKERFSAKCLPNSPCSLEIQATKLEDSAVYFCASSQ

SEQ ID NO: 86363 - protein, 115 aa, Homo sapiens; identical to SEQ ID NO: 86362
  Payload ID: 17240
  Gene Symbol: TRBV16
  Gene Name: T cell receptor beta variable 16 (gene/pseudogene)
  ENSP ID: ENSP00000487913

SEQ ID NO: 86364 - protein, 114 aa, Homo sapiens
  Payload ID: 17241
  Gene Symbol: TRBV17
  Gene Name: T cell receptor beta variable 17 (non-functional)
  ENSP ID: ENSP00000483468
MDIWLLCWVTLCLLAAGHSEPGVSQTPRHKVTNMGQEVILRCDPSSGHMFVHWYRQNLRQEMKLLISFQYQNIAVDSGMPKERFTAERPNGTSSTLKIHPAEPRDSAVYLYSSG

SEQ ID NO: 86365 - protein, 114 aa, Homo sapiens; identical to SEQ ID NO: 86364
  Payload ID: 17241
  Gene Symbol: TRBV17
  Gene Name: T cell receptor beta variable 17 (non-functional)
  ENSP ID: ENSP00000488775

SEQ ID NO: 86366 - protein, 115 aa, Homo sapiens
  Payload ID: 17242
  Gene Symbol: TRBV18
  Gene Name: T cell receptor beta variable 18
  ENSP ID: ENSP00000483504
MDTRLLCCAVICLLGAGLSNAGVMQNPRHLVRRRGQEARLRCSPMKGHSHVYWYRQLPEEGLKFMVYLQKENIIDESGMPKERFSAEFPKEGPSILRIQQVVRGDSAAYFCASSP

SEQ ID NO: 86367 - protein, 115 aa, Homo sapiens
  Payload ID: 17242
  Gene Symbol: TRBV18
  Gene Name: T cell receptor beta variable 18
  ENSP ID: ENSP00000488621
MDTRVLCCAVICLLGAGLSNAGVMQNPRHLVRRRGQEARLRCSPMKGHSHVYWYRQLPEEGLKFMVYLQKENIIDESGMPKERFSAEFPKEGPSILRIQQVVRGDSAAYFCASSP

SEQ ID NO: 86368 - protein, 114 aa, Homo sapiens
  Payload ID: 17243
  Gene Symbol: TRBV19
  Gene Name: T cell receptor beta variable 19
  ENSP ID: ENSP00000374916
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSI

SEQ ID NO: 86369 - protein, 114 aa, Homo sapiens
  Payload ID: 17243
  Gene Symbol: TRBV19
  Gene Name: T cell receptor beta variable 19
  ENSP ID: ENSP00000487807
MSNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSI

SEQ ID NO: 86370 - protein, 115 aa, Homo sapiens
  Payload ID: 17244
  Gene Symbol: TRBV2
  Gene Name: T cell receptor beta variable 2
  ENSP ID: ENSP00000388523
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSE

SEQ ID NO: 86371 - protein, 115 aa, Homo sapiens
  Payload ID: 17244
  Gene Symbol: TRBV2
  Gene Name: T cell receptor beta variable 2
  ENSP ID: ENSP00000487939
MDTWLVCWAIFSLLKAGLTEPEVTQTPSHQVTQMGQEVILHCVPISNHLYFYWYRQILGQKVEFLVSFYNNEISEKSEIFDDQFSVERPDGSNFTLKIRSTKLEDSAMYFCASSE

SEQ ID NO: 86372 - protein, 130 aa, Homo sapiens
  Payload ID: 17245
  Gene Symbol: TRBV20OR9-2
  Gene Name: T cell receptor beta variable 20/OR9-2 (non-functional)
  ENSP ID: ENSP00000368747
METVVTTLPREGGVGPSRKMLLLLLLLGPGSGLSAVVSQHPSRVICKSGTSVNIECRSLDFQATTMFWYRQLRKQSLMLMATSNEGSEVTYEQGVKKDKFPINHPNLTFSALTVTSAHPEDSSFYICSAR

SEQ ID NO: 86373 - protein, 111 aa, Homo sapiens
  Payload ID: 17246
  Gene Symbol: TRBV20-1
  Gene Name: T cell receptor beta variable 20-1
  ENSP ID: ENSP00000374917
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSAR

SEQ ID NO: 86374 - protein, 111 aa, Homo sapiens
  Payload ID: 17246
  Gene Symbol: TRBV20-1
  Gene Name: T cell receptor beta variable 20-1
  ENSP ID: ENSP00000488099
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSAR

SEQ ID NO: 86375 - protein, 123 aa, Homo sapiens
  Payload ID: 17247
  Gene Symbol: TRBV21OR9-2
  Gene Name: T cell receptor beta variable 21/OR9-2 (pseudogene)
  ENSP ID: ENSP00000333603
  MOD_RES (1)..(1): Any amino acid
XRFLSEPTRCLRLLCCVALSFWGAASMDTKVTQRPRFLVKANEQKAKMDCVPIKRHSYVYWYHKTLEEELKFFIYFQNEEIIQKAEIINERFSAQCPQNSPCTLEIQSTESGDTARYFCANSK

SEQ ID NO: 86376 - protein, 112 aa, Homo sapiens
  Payload ID: 17248
  Gene Symbol: TRBV23OR9-2
  Gene Name: T cell receptor beta variable 23/OR9-2 (non-functional)
  ENSP ID: ENSP00000374912
  MOD_RES (1)..(1): Any amino acid
XTGTRLLGWVALCLLAAGCFHAKVTQTPGYLVKGKGRKTKMYCTPKNGHTFVCWYQQNQNKEFMFLISFQNEQVLQEMEMHKKRFSSQCPKNPPCSLAILSSEPGDTALYLC

SEQ ID NO: 86377 - protein, 115 aa, Homo sapiens
  Payload ID: 17249
  Gene Symbol: TRBV23-1
  Gene Name: T cell receptor beta variable 23-1 (non-functional)
  ENSP ID: ENSP00000374919
MGTRLLGCAALCLLAADSFHAKVTQTPGHLVKGKGQKTKMDCTPEKGHTFVYWYQQNQNKEFMLLISFQNEQVLQETEMHKKRFSSQCPKNAPCSLAILSSEPGDTALYLCASSQ

SEQ ID NO: 86378 - protein, 115 aa, Homo sapiens; identical to SEQ ID NO: 86377
  Payload ID: 17249
  Gene Symbol: TRBV23-1
  Gene Name: T cell receptor beta variable 23-1 (non-functional)
  ENSP ID: ENSP00000487718

SEQ ID NO: 86379 - protein, 115 aa, Homo sapiens
  Payload ID: 17250
  Gene Symbol: TRBV24-1
  Gene Name: T cell receptor beta variable 24-1
  ENSP ID: ENSP00000374920
MASLLFFCGAFYLLGTGSMDADVTQTPRNRITKTGKRIMLECSQTKGHDRMYWYRQDPGLGLQLIYYSFDVKDINKGEISDGYSVSRQAQAKFSLSLESAIPNQTALYFCATSDL

SEQ ID NO: 86380 - protein, 115 aa, Homo sapiens
  Payload ID: 17250
  Gene Symbol: TRBV24-1
  Gene Name: T cell receptor beta variable 24-1
  ENSP ID: ENSP00000488057
MASLLFFCGAFYLLGTGSMDADVTQTPRNRITKTGKRIMLECSQTKGHDRMYWYRQDPGLGLRLIYYSFDVKDINKGEISDGYSVSRQAQAKFSLSLESAIPNQTALYFCATSDL

SEQ ID NO: 86381 - protein, 114 aa, Homo sapiens
  Payload ID: 17251
  Gene Symbol: TRBV25-1
  Gene Name: T cell receptor beta variable 25-1
  ENSP ID: ENSP00000374921
MTIRLLCYVGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSE

SEQ ID NO: 86382 - protein, 114 aa, Homo sapiens
  Payload ID: 17251
  Gene Symbol: TRBV25-1
  Gene Name: T cell receptor beta variable 25-1
  ENSP ID: ENSP00000479511
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSE

SEQ ID NO: 86383 - protein, 114 aa, Homo sapiens
  Payload ID: 17252
  Gene Symbol: TRBV27
  Gene Name: T cell receptor beta variable 27
  ENSP ID: ENSP00000374922
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSL

SEQ ID NO: 86384 - protein, 114 aa, Homo sapiens; identical to SEQ ID NO: 86383
  Payload ID: 17252
  Gene Symbol: TRBV27
  Gene Name: T cell receptor beta variable 27
  ENSP ID: ENSP00000488274

SEQ ID NO: 86385 - protein, 114 aa, Homo sapiens
  Payload ID: 17253
  Gene Symbol: TRBV28
  Gene Name: T cell receptor beta variable 28
  ENSP ID: ENSP00000374923
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSL

SEQ ID NO: 86386 - protein, 114 aa, Homo sapiens; identical to SEQ ID NO: 86385
  Payload ID: 17253
  Gene Symbol: TRBV28
  Gene Name: T cell receptor beta variable 28
  ENSP ID: ENSP00000480928

SEQ ID NO: 86387 - protein, 111 aa, Homo sapiens
  Payload ID: 17254
  Gene Symbol: TRBV29-1
  Gene Name: T cell receptor beta variable 29-1
  ENSP ID: ENSP00000395459
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVE

SEQ ID NO: 86388 - protein, 111 aa, Homo sapiens; identical to SEQ ID NO: 86387
  Payload ID: 17254
  Gene Symbol: TRBV29-1
  Gene Name: T cell receptor beta variable 29-1
  ENSP ID: ENSP00000488861

SEQ ID NO: 86389 - protein, 111 aa, Homo sapiens
  Payload ID: 17255
  Gene Symbol: TRBV30
  Gene Name: T cell receptor beta variable 30 (gene/pseudogene)
  ENSP ID: ENSP00000397118
MLCSLLALLLGTFFGVRSQTIHQWPATLVQPVGSPLSLECTVEGTSNPNLYWYRQAAGRGLQLLFYSVGIGQISSEVPQNLSASRPQDRQFILSSKKLLLSDSGFYLCAWS

SEQ ID NO: 86390 - protein, 111 aa, Homo sapiens; identical to SEQ ID NO: 86389
  Payload ID: 17255
  Gene Symbol: TRBV30
  Gene Name: T cell receptor beta variable 30 (gene/pseudogene)
  ENSP ID: ENSP00000487814

SEQ ID NO: 86391 - protein, 114 aa, Homo sapiens
  Payload ID: 17256
  Gene Symbol: TRBV3-1
  Gene Name: T cell receptor beta variable 3-1
  ENSP ID: ENSP00000374910
MGCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASSQ

SEQ ID NO: 86392 - protein, 114 aa, Homo sapiens; identical to SEQ ID NO: 86391
  Payload ID: 17256
  Gene Symbol: TRBV3-1
  Gene Name: T cell receptor beta variable 3-1
  ENSP ID: ENSP00000488814

SEQ ID NO: 86393 - protein, 114 aa, Homo sapiens
  Payload ID: 17257
  Gene Symbol: TRBV4-1
  Gene Name: T cell receptor beta variable 4-1
  ENSP ID: ENSP00000374880
MGCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQ

SEQ ID NO: 86394 - protein, 114 aa, Homo sapiens
  Payload ID: 17257
  Gene Symbol: TRBV4-1
  Gene Name: T cell receptor beta variable 4-1
  ENSP ID: ENSP00000488131
MGCRLLCCAVLCLLGAVPIDTEVTQTPKHLVMGMTNKKSLKCEQHMGHRAMYWYKQKAKKPPELMFVYSYEKLSINESVRSRFSPECPNSSLLNLHLHALQPEDSALYLCASSQ

SEQ ID NO: 86395 - protein, 114 aa, Homo sapiens
  Payload ID: 17258
  Gene Symbol: TRBV4-2
  Gene Name: T cell receptor beta variable 4-2
  ENSP ID: ENSP00000374915
MGCRLLCCAVLCLLGAVPMETGVTQTPRHLVMGMTNKKSLKCEQHLGHNAMYWYKQSAKKPLELMFVYNFKEQTENNSVPSRFSPECPNSSHLFLHLHTLQPEDSALYLCASSQ

SEQ ID NO: 86396 - protein, 114 aa, Homo sapiens; identical to SEQ ID NO: 86395
  Payload ID: 17258
  Gene Symbol: TRBV4-2
  Gene Name: T cell receptor beta variable 4-2
  ENSP ID: ENSP00000487667

SEQ ID NO: 86397 - protein, 114 aa, Homo sapiens
  Payload ID: 17259
  Gene Symbol: TRBV4-3
  Gene Name: T cell receptor beta variable 4-3
  ENSP ID: ENSP00000488576
MGCRLLCCAVLCLLGAVPMETGVTQTPRHLVMGMTNKKSLKCEQHLGHNAMYWYKQSAKKPLELMFVYSLEERVENNSVPSRFSPECPNSSHLFLHLHTLQPEDSALYLCASSQ

SEQ ID NO: 86398 - protein, 114 aa, Homo sapiens
  Payload ID: 17260
  Gene Symbol: TRBV5-1
  Gene Name: T cell receptor beta variable 5-1
  ENSP ID: ENSP00000374904
MGSRLLCWVLLCLLGAGPVKAGVTQTPRYLIKTRGQQVTLSCSPISGHRSVSWYQQTPGQGLQFLFEYFSETQRNKGNFPGRFSGRQFSNSRSEMNVSTLELGDSALYLCASSL

SEQ ID NO: 86399 - protein, 114 aa, Homo sapiens; identical to SEQ ID NO: 86398
  Payload ID: 17260
  Gene Symbol: TRBV5-1
  Gene Name: T cell receptor beta variable 5-1
  ENSP ID: ENSP00000488308

SEQ ID NO: 86400 - protein, 114 aa, Homo sapiens
  Payload ID: 17261
  Gene Symbol: TRBV5-3
  Gene Name: T cell receptor beta variable 5-3 (non-functional)
  ENSP ID: ENSP00000374885
MGPGLLCWELLYLLGAGPVEAGVTQSPTHLIKTRGQQVTLRCSPISGHSSVSWYQQAPGQGPQFIFEYANELRRSEGNFPNRFSGRQFHDYCSEMNVSALELGDSALYLCARSL

SEQ ID NO: 86401 - protein, 114 aa, Homo sapiens
  Payload ID: 17261
  Gene Symbol: TRBV5-3
  Gene Name: T cell receptor beta variable 5-3 (non-functional)
  ENSP ID: ENSP00000488267
MGPGLLCWELLYLLGAGPVEAGVTQSPTHLIKTRGQQVTLRCSPISGHSSVSWYQQAPGQGPQFIFEYANELRRSEGNFPNRFSGRQFHDCCSEMNVSALELGDSALYLCARSL

SEQ ID NO: 86402 - protein, 114 aa, Homo sapiens
  Payload ID: 17262
  Gene Symbol: TRBV5-4
  Gene Name: T cell receptor beta variable 5-4
  ENSP ID: ENSP00000413966
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSL

SEQ ID NO: 86403 - protein, 114 aa, Homo sapiens
  Payload ID: 17262
  Gene Symbol: TRBV5-4
  Gene Name: T cell receptor beta variable 5-4
  ENSP ID: ENSP00000488374
MGPGLLCWALLCLLGAGSVDAGVTQSPTHLIKTRGQQVTLRCSSQSGHNTVSWYQQALGQGPQFIFQYYREEENGRGNFPPRFSGLQFPNDSSELNVNALELDDSALYLCASSL

SEQ ID NO: 86404 - protein, 114 aa, Homo sapiens
  Payload ID: 17263
  Gene Symbol: TRBV5-5
  Gene Name: T cell receptor beta variable 5-5
  ENSP ID: ENSP00000374895
MGPGLLCWVLLCLLGAGPVDAGVTQSPTHLIKTRGQQVTLRCSPISGHKSVSWYQQVLGQGPQFIFQYYEKEERGRGNFPDRFSARQFPNYSSELNVNALLLGDSALYLCASSL

SEQ ID NO: 86405 - protein, 114 aa, Homo sapiens
  Payload ID: 17263
  Gene Symbol: TRBV5-5
  Gene Name: T cell receptor beta variable 5-5
  ENSP ID: ENSP00000488241
MGPGLLCWVLLCLLVAGPVDAGVTQSPTHLIKTRGQQVTLRCSPISGHKSVSWYQQVLGQGPQFIFQYYEKEERGRGNFPDRFSARQFPNYSSELNVNALLLGDSALYLCASSL

SEQ ID NO: 86406 - protein, 114 aa, Homo sapiens
  Payload ID: 17264
  Gene Symbol: TRBV5-6
  Gene Name: T cell receptor beta variable 5-6
  ENSP ID: ENSP00000374898
MGPGLLCWALLCLLGAGLVDAGVTQSPTHLIKTRGQQVTLRCSPKSGHDTVSWYQQALGQGPQFIFQYYEEEERQRGNFPDRFSGHQFPNYSSELNVNALLLGDSALYLCASSL

SEQ ID NO: 86407 - protein, 114 aa, Homo sapiens; identical to SEQ ID NO: 86406
  Payload ID: 17264
  Gene Symbol: TRBV5-6
  Gene Name: T cell receptor beta variable 5-6
  ENSP ID: ENSP00000487850

SEQ ID NO: 86408 - protein, 114 aa, Homo sapiens
  Payload ID: 17265
  Gene Symbol: TRBV5-7
  Gene Name: T cell receptor beta variable 5-7 (non-functional)
  ENSP ID: ENSP00000374901
MGPGLLCWVLLCPLGEGPVDAGVTQSPTHLIKTRGQHVTLRCSPISGHTSVSSYQQALGQGPQFIFQYYEKEERGRGNFPDQFSGHQFPNYSSELNVNALLLGDSALYLCASSL

SEQ ID NO: 86409 - protein, 114 aa, Homo sapiens; identical to SEQ ID NO: 86408
  Payload ID: 17265
  Gene Symbol: TRBV5-7
  Gene Name: T cell receptor beta variable 5-7 (non-functional)
  ENSP ID: ENSP00000488478

SEQ ID NO: 86410 - protein, 114 aa, Homo sapiens
  Payload ID: 17266
  Gene Symbol: TRBV5-8
  Gene Name: T cell receptor beta variable 5-8
  ENSP ID: ENSP00000488017
MGPRLLFWALLCLLGTGPVEAGVTQSPTHLIKTRGQQATLRCSPISGHTSVYWYQQALGLGLQFLLWYDEGEERNRGNFPPRFSGRQFPNYSSELNVNALELEDSALYLCASSL

SEQ ID NO: 86411 - protein, 114 aa, Homo sapiens
  Payload ID: 17267
  Gene Symbol: TRBV6-1
  Gene Name: T cell receptor beta variable 6-1
  ENSP ID: ENSP00000374876
MSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSE

SEQ ID NO: 86412 - protein, 114 aa, Homo sapiens; identical to SEQ ID NO: 86411
  Payload ID: 17267
  Gene Symbol: TRBV6-1
  Gene Name: T cell receptor beta variable 6-1
  ENSP ID: ENSP00000488756

SEQ ID NO: 86413 - protein, 114 aa, Homo sapiens
  Payload ID: 17268
  Gene Symbol: TRBV6-2
  Gene Name: T cell receptor beta variable 6-2 (gene/pseudogene)
  ENSP ID: ENSP00000488603
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSY

SEQ ID NO: 86414 - protein, 114 aa, Homo sapiens; identical to SEQ ID NO: 86413
  Payload ID: 17268
  Gene Symbol: TRBV6-2
  Gene Name: T cell receptor beta variable 6-2 (gene/pseudogene)
  ENSP ID: ENSP00000488969

SEQ ID NO: 86415 - protein, 114 aa, Homo sapiens; identical to SEQ ID NO: 86413
  Payload ID: 17269
  Gene Symbol: TRBV6-3
  Gene Name: T cell receptor beta variable 6-3
  ENSP ID: ENSP00000488127

SEQ ID NO: 86416 - protein, 114 aa, Homo sapiens
  Payload ID: 17270
  Gene Symbol: TRBV6-4
  Gene Name: T cell receptor beta variable 6-4
  ENSP ID: ENSP00000374883
MSIRLLCCVAFSLLWAGPVTAGITQAPTSQILAAGRSMTLRCTQDMRHNAMYWYRQDLGLGLRLIHYSNTAGTTGKGEVPDGYSVSRANTDDFPLTLASAVPSQTSVYFCASSD

SEQ ID NO: 86417 - protein, 114 aa, Homo sapiens
  Payload ID: 17270
  Gene Symbol: TRBV6-4
  Gene Name: T cell receptor beta variable 6-4
  ENSP ID: ENSP00000487798
MRIRLLCCVAFSLLWAGPVIAGITQAPTSQILAAGRRMTLRCTQDMRHNAMYWYRQDLGLGLRLIHYSNTAGTTGKGEVPDGYSVSRANTDDFPLTLASAVPSQTSVYFCASSD

SEQ ID NO: 86418 - protein, 114 aa, Homo sapiens
  Payload ID: 17271
  Gene Symbol: TRBV6-5
  Gene Name: T cell receptor beta variable 6-5
  ENSP ID: ENSP00000374891
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSY

SEQ ID NO: 86419 - protein, 125 aa, Homo sapiens
  Payload ID: 17271
  Gene Symbol: TRBV6-5
  Gene Name: T cell receptor beta variable 6-5
  ENSP ID: ENSP00000481327
MSLGLLCCGAFSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASLLHSATRPTVTSA

SEQ ID NO: 86420 - protein, 114 aa, Homo sapiens; identical to SEQ ID NO: 86418
  Payload ID: 17271
  Gene Symbol: TRBV6-5
  Gene Name: T cell receptor beta variable 6-5
  ENSP ID: ENSP00000488123

SEQ ID NO: 86421 - protein, 114 aa, Homo sapiens
  Payload ID: 17272
  Gene Symbol: TRBV6-6
  Gene Name: T cell receptor beta variable 6-6
  ENSP ID: ENSP00000374894
MSISLLCCAAFPLLWAGPVNAGVTQTPKFRILKIGQSMTLQCAQDMNHNYMYWYRQDPGMGLKLIYYSVGAGITDKGEVPNGYNVSRSTTEDFPLRLELAAPSQTSVYFCASSY

SEQ ID NO: 86422 - protein, 114 aa, Homo sapiens
  Payload ID: 17272
  Gene Symbol: TRBV6-6
  Gene Name: T cell receptor beta variable 6-6
  ENSP ID: ENSP00000488741
MSISLLCCAAFPLLWAGPVNAGVTQTPKFRILKIGQSMTLQCAQDMNHNYMYWYRQDPGMGLKLIYYSVGAGITDKGEVPNGYNVSRSTTEYFPLRLELAAPSQTSVYFCASSY

SEQ ID NO: 86423 - protein, 114 aa, Homo sapiens
  Payload ID: 17273
  Gene Symbol: TRBV6-7
  Gene Name: T cell receptor beta variable 6-7 (non-functional)
  ENSP ID: ENSP00000374896
MSLGLLCCVAFSLLWAGPMNAGVTQTPKFHVLKTGQSMTLLCAQDMNHEYMYRYRQDPGKGLRLIYYSVAAALTDKGEVPNGYNVSRSNTEDFPLKLESAAPSQTSVYFCASSY

SEQ ID NO: 86424 - protein, 114 aa, Homo sapiens; identical to SEQ ID NO: 86423
  Payload ID: 17273
  Gene Symbol: TRBV6-7
  Gene Name: T cell receptor beta variable 6-7 (non-functional)
  ENSP ID: ENSP00000488335

SEQ ID NO: 86425 - protein, 113 aa, Homo sapiens
  Payload ID: 17274
  Gene Symbol: TRBV6-8
  Gene Name: T cell receptor beta variable 6-8
  ENSP ID: ENSP00000374899
MSLGLLCCAAFSLLWAGPVNAGVTQTPKFHILKTGQSMTLQCAQDMNHGYMSWYRQDPGMGLRLIYYSAAAGTTDKEVPNGYNVSRLNTEDFPLRLVSAAPSQTSVYLCASSY

SEQ ID NO: 86426 - protein, 113 aa, Homo sapiens
  Payload ID: 17274
  Gene Symbol: TRBV6-8
  Gene Name: T cell receptor beta variable 6-8
  ENSP ID: ENSP00000488870
MSLGLLCCAAFSLLWAGPVNAGVTQTPKFHILKTGQSMTLQCAQDMNHGYMSWYRQDPGMGLRLIYYSAAAGTTDKEVPNGYNVSRLNTEDFPLRLVSAAPSRTSVYLCASSY

SEQ ID NO: 86427 - protein, 114 aa, Homo sapiens
  Payload ID: 17275
  Gene Symbol: TRBV6-9
  Gene Name: T cell receptor beta variable 6-9
  ENSP ID: ENSP00000488280
MSIGLLCCVAFSLLWAGPVNAGVTQTPKFHILKTGQSMTLQCAQDMNHGYLSWYRQDPGMGLRRIHYSVAAGITDKGEVPDGYNVSRSNTEDFPLRLESAAPSQTSVYFCASSY

SEQ ID NO: 86428 - protein, 115 aa, Homo sapiens
  Payload ID: 17276
  Gene Symbol: TRBV7-1
  Gene Name: T cell receptor beta variable 7-1 (non-functional)
  ENSP ID: ENSP00000448600
MGTRLLCWAAICLLGADHTGAGVSQSLRHKVAKKGKDVALRYDPISGHNALYWYRQSLGQGLEFPIYFQGKDAADKSGLPRDRFSAQRSEGSISTLKFQRTQQGDLAVYLCASSS

SEQ ID NO: 86429 - protein, 115 aa, Homo sapiens; identical to SEQ ID NO: 86428
  Payload ID: 17276
  Gene Symbol: TRBV7-1
  Gene Name: T cell receptor beta variable 7-1 (non-functional)
  ENSP ID: ENSP00000488287

SEQ ID NO: 86430 - protein, 115 aa, Homo sapiens
  Payload ID: 17277
  Gene Symbol: TRBV7-2
  Gene Name: T cell receptor beta variable 7-2
  ENSP ID: ENSP00000488152
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSL

SEQ ID NO: 86431 - protein, 115 aa, Homo sapiens; identical to SEQ ID NO: 86430
  Payload ID: 17277
  Gene Symbol: TRBV7-2
  Gene Name: T cell receptor beta variable 7-2
  ENSP ID: ENSP00000489072

SEQ ID NO: 86432 - protein, 115 aa, Homo sapiens
  Payload ID: 17278
  Gene Symbol: TRBV7-3
  Gene Name: T cell receptor beta variable 7-3
  ENSP ID: ENSP00000374884
MGTRLLCWAALCLLGADHTGAGVSQTPSNKVTEKGKDVELRCDPISGHTALYWYRQSLGQGPEFLIYFQGTGAADDSGLPKDRFFAVRPEGSVSTLKIQRTEQGDSAAYLRASSL

SEQ ID NO: 86433 - protein, 115 aa, Homo sapiens
  Payload ID: 17278
  Gene Symbol: TRBV7-3
  Gene Name: T cell receptor beta variable 7-3
  ENSP ID: ENSP00000488108
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSL

SEQ ID NO: 86434 - protein, 115 aa, Homo sapiens
  Payload ID: 17279
  Gene Symbol: TRBV7-4
  Gene Name: T cell receptor beta variable 7-4 (gene/pseudogene)
  ENSP ID: ENSP00000374892
MGTRLLCWVVLGFLGTDHTGAGVSQSPRYKVAKRGRDVALRCDSISGHVTLYWYRQTLGQGSEVLTYSQSDAQRDKSGRPSGRFSAERPERSVSTLKIQRTEQGDSAVYLCASSL

SEQ ID NO: 86435 - protein, 115 aa, Homo sapiens
  Payload ID: 17279
  Gene Symbol: TRBV7-4
  Gene Name: T cell receptor beta variable 7-4 (gene/pseudogene)
  ENSP ID: ENSP00000488823
MGTRLLCWVVLGFLGTDHTGAGVSQSPRYKVAKRGRDVALRCDSISGHVTLYWYRQTLGQGSEVLTYSQSDAQRDKSGRPSGRFSAERPERSVSTLKIQCTEQGDSAVYLCASSL

SEQ ID NO: 86436 - protein, 115 aa, Homo sapiens
  Payload ID: 17280
  Gene Symbol: TRBV7-6
  Gene Name: T cell receptor beta variable 7-6
  ENSP ID: ENSP00000374897
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSL

SEQ ID NO: 86437 - protein, 115 aa, Homo sapiens
  Payload ID: 17280
  Gene Symbol: TRBV7-6
  Gene Name: T cell receptor beta variable 7-6
  ENSP ID: ENSP00000488212
MGTSLLCWVVLGFLGTDHTGAGVSQSPRYKVTKRGQDVALRCDPISGHVSLYWYRQALGQGPEFLTYFNYEAQQDKSGLPNDRFSAERPEGSVSTLTIQRTEQRDSAMYRCASSL

SEQ ID NO: 86438 - protein, 115 aa, Homo sapiens
  Payload ID: 17281
  Gene Symbol: TRBV7-7
  Gene Name: T cell receptor beta variable 7-7
  ENSP ID: ENSP00000374900
MGTSLLCWVVLGFLGTDHTGAGVSQSPRYKVTKRGQDVTLRCDPISSHATLYWYQQALGQGPEFLTYFNYEAQPDKSGLPSDRFSAERPEGSISTLTIQRTEQRDSAMYRCASSL

SEQ ID NO: 86439 - protein, 115 aa, Homo sapiens; identical to SEQ ID NO: 86438
  Payload ID: 17281
  Gene Symbol: TRBV7-7
  Gene Name: T cell receptor beta variable 7-7
  ENSP ID: ENSP00000488424

SEQ ID NO: 86440 - protein, 115 aa, Homo sapiens
  Payload ID: 17282
  Gene Symbol: TRBV7-8
  Gene Name: T cell receptor beta variable 7-8
  ENSP ID: ENSP00000488190
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSL

SEQ ID NO: 86441 - protein, 115 aa, Homo sapiens
  Payload ID: 17283
  Gene Symbol: TRBV7-9
  Gene Name: T cell receptor beta variable 7-9
  ENSP ID: ENSP00000478301
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSL

SEQ ID NO: 86442 - protein, 115 aa, Homo sapiens
  Payload ID: 17283
  Gene Symbol: TRBV7-9
  Gene Name: T cell receptor beta variable 7-9
  ENSP ID: ENSP00000487884
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSL

SEQ ID NO: 86443 - protein, 114 aa, Homo sapiens
  Payload ID: 17284
  Gene Symbol: TRBV9
  Gene Name: T cell receptor beta variable 9
  ENSP ID: ENSP00000374886
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSV

SEQ ID NO: 86444 - protein, 114 aa, Homo sapiens
  Payload ID: 17284
  Gene Symbol: TRBV9
  Gene Name: T cell receptor beta variable 9
  ENSP ID: ENSP00000488515
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSV

SEQ ID NO: 86445 - protein, 154 aa, Homo sapiens
  Payload ID: 17285
  Gene Symbol: TRDC
  Gene Name: T cell receptor delta constant
  ENSP ID: ENSP00000451468
  MOD_RES (1)..(1): Any amino acid
XSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 86446 - protein, 2 aa, Homo sapiens
  Payload ID: 17286
  Gene Symbol: TRDD1
  Gene Name: T cell receptor delta diversity 1
  ENSP ID: ENSP00000451042
EI

SEQ ID NO: 86447 - protein, 3 aa, Homo sapiens
  Payload ID: 17287
  Gene Symbol: TRDD2
  Gene Name: T cell receptor delta diversity 2
  ENSP ID: ENSP00000451515
PSY

SEQ ID NO: 86448 - protein, 4 aa, Homo sapiens
  Payload ID: 17288
  Gene Symbol: TRDD3
  Gene Name: T cell receptor delta diversity 3
  ENSP ID: ENSP00000452494
TGGY

SEQ ID NO: 86449 - protein, 17 aa, Homo sapiens
  Payload ID: 17289
  Gene Symbol: TRDJ1
  Gene Name: T cell receptor delta joining 1
  ENSP ID: ENSP00000452345
  MOD_RES (1)..(1): Any amino acid
XTDKLIFGKGTRVTVEP

SEQ ID NO: 86450 - protein, 18 aa, Homo sapiens
  Payload ID: 17290
  Gene Symbol: TRDJ2
  Gene Name: T cell receptor delta joining 2
  ENSP ID: ENSP00000450875
  MOD_RES (1)..(1): Any amino acid
XLTAQLFFGKGTQLIVEP

SEQ ID NO: 86451 - protein, 20 aa, Homo sapiens
  Payload ID: 17291
  Gene Symbol: TRDJ3
  Gene Name: T cell receptor delta joining 3
  ENSP ID: ENSP00000451140
  MOD_RES (1)..(1): Any amino acid
XSWDTRQMFFGTGIKLFVEP

SEQ ID NO: 86452 - protein, 16 aa, Homo sapiens
  Payload ID: 17292
  Gene Symbol: TRDJ4
  Gene Name: T cell receptor delta joining 4
  ENSP ID: ENSP00000452040
  MOD_RES (1)..(1): Any amino acid
XRPLIFGKGTYLEVQQ

SEQ ID NO: 86453 - protein, 115 aa, Homo sapiens
  Payload ID: 17293
  Gene Symbol: TRDV1
  Gene Name: T cell receptor delta variable 1
  ENSP ID: ENSP00000452111
MLFSSLLCVFVAFSYSGSSVAQKVTQAQSSVSMPVRKAVTLNCLYETSWWSYYIFWYKQLPSKEMIFLIRQGSDEQNAKSGRYSVNFKKAAKSVALTISALQLEDSAKYFCALGE

SEQ ID NO: 86454 - protein, 34 aa, Homo sapiens
  Payload ID: 17293
  Gene Symbol: TRDV1
  Gene Name: T cell receptor delta variable 1
  ENSP ID: ENSP00000484940
KSGRYSVNFKKAAKSVALTISALQLEDSAKYFCA

SEQ ID NO: 86455 - protein, 115 aa, Homo sapiens
  Payload ID: 17294
  Gene Symbol: TRDV2
  Gene Name: T cell receptor delta variable 2
  ENSP ID: ENSP00000451578
MQRISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDT

SEQ ID NO: 86456 - protein, 113 aa, Homo sapiens
  Payload ID: 17295
  Gene Symbol: TRDV3
  Gene Name: T cell receptor delta variable 3
  ENSP ID: ENSP00000451750
MILTVGFSFLFFYRGTLCDKVTQSSPDQTVASGSEVVLLCTYDTVYSNPDLFWYRIRPDYSFQFVFYGDNSRSEGADFTQGRFSVKHILTQKAFHLVISPVRTEDSATYYCAF

SEQ ID NO: 86457 - protein, 173 aa, Homo sapiens
  Payload ID: 17296
  Gene Symbol: TRGC1
  Gene Name: T cell receptor gamma constant 1
  ENSP ID: ENSP00000404817
  MOD_RES (1)..(1): Any amino acid
XKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 86458 - protein, 189 aa, Homo sapiens
  Payload ID: 17297
  Gene Symbol: TRGC2
  Gene Name: T cell receptor gamma constant 2
  ENSP ID: ENSP00000413437
  MOD_RES (1)..(1): Any amino acid
XKQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKYNYSKDANDVITMDPKDNWSKDANDTLLLQLTNTSAYYTYLLLLLKSVVYFAIITCCLLRRTAFCCNGEKS

SEQ ID NO: 86459 - protein, 321 aa, Homo sapiens
  Payload ID: 17297
  Gene Symbol: TRGC2
  Gene Name: T cell receptor gamma constant 2
  ENSP ID: ENSP00000480566
MRWALAVLLAFLSPASQISSNLEGRTKSVTRLTGSSAEITCDLPGASTLYIHWYLHQEGKAPQCLLYYEPYYSRVVLESGITPGKYDTGSTRSNWNLRLQNLIKNDSGFYYCATWDRHSIQTLSACGSFLPIDKQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKYNYSKDANDVITMDPKDNWSKDANDTLLLQLTNTSAYYTYLLLLLKSVVYFAIITCCLLRRTAFCCNGEKS

SEQ ID NO: 86460 - protein, 17 aa, Homo sapiens
  Payload ID: 17298
  Gene Symbol: TRGJ1
  Gene Name: T cell receptor gamma joining 1
  ENSP ID: ENSP00000420798
  MOD_RES (1)..(1): Any amino acid
XNYYKKLFGSGTTLVVT

SEQ ID NO: 86461 - protein, 17 aa, Homo sapiens
  Payload ID: 17299
  Gene Symbol: TRGJ2
  Gene Name: T cell receptor gamma joining 2
  ENSP ID: ENSP00000417149
  MOD_RES (1)..(1): Any amino acid
XNYYKKLFGSGTTLVVT

SEQ ID NO: 86462 - protein, 20 aa, Homo sapiens
  Payload ID: 17300
  Gene Symbol: TRGJP
  Gene Name: T cell receptor gamma joining P
  ENSP ID: ENSP00000418089
GQELGKKIKVFGPGTKLIIT

SEQ ID NO: 86463 - protein, 20 aa, Homo sapiens
  Payload ID: 17301
  Gene Symbol: TRGJP1
  Gene Name: T cell receptor gamma joining P1
  ENSP ID: ENSP00000419604
  MOD_RES (1)..(1): Any amino acid
XTTGWFKIFAEGTKLIVTSP

SEQ ID NO: 86464 - protein, 20 aa, Homo sapiens
  Payload ID: 17302
  Gene Symbol: TRGJP2
  Gene Name: T cell receptor gamma joining P2
  ENSP ID: ENSP00000418697
  MOD_RES (1)..(1): Any amino acid
XSSDWIKTFAKGTRLIVTSP

SEQ ID NO: 86465 - protein, 117 aa, Homo sapiens
  Payload ID: 17303
  Gene Symbol: TRGV1
  Gene Name: T cell receptor gamma variable 1 (non-functional)
  ENSP ID: ENSP00000374871
MRWALAVLLAFLSPASQISSNLEGRTKSVTRLTGSSAEITCDLPGASTLYIHWYLHQEGKAPQCLLYYEPYYSRVVLESGITPGKYDTGSTRSNWNLRLQNLIKNDSGFYYCATWDR

SEQ ID NO: 86466 - protein, 117 aa, Homo sapiens
  Payload ID: 17304
  Gene Symbol: TRGV10
  Gene Name: T cell receptor gamma variable 10 (non-functional)
  ENSP ID: ENSP00000374864
MFIGNSPLLLTVGLGLSKVEQFQLSISTEVKKSIDIPCKISSTRFETDVIHWYRQKPNQALEHLIYIVSTKSAARRSMGKTSNKVEARKNSQTLTSILTIKSVEKEDMAVYYCAAWD

SEQ ID NO: 86467 - protein, 103 aa, Homo sapiens
  Payload ID: 17305
  Gene Symbol: TRGV11
  Gene Name: T cell receptor gamma variable 11 (non-functional)
  ENSP ID: ENSP00000374863
LGQLEQPEISISRPANKSAHISWKASIQGFSSKIIHWYWQKPNKGLEYLLHVFLTISAQDCSGGKTKKLEVSKNAHTSTSTLKIKFLEKEDEVVYHCACWIRH

SEQ ID NO: 86468 - protein, 118 aa, Homo sapiens
  Payload ID: 17306
  Gene Symbol: TRGV2
  Gene Name: T cell receptor gamma variable 2
  ENSP ID: ENSP00000404928
MQWALAVLLAFLSPASQKSSNLEGRTKSVIRQTGSSAEITCDLAEGSNGYIHWYLHQEGKAPQRLQYYDSYNSKVVLESGVSPGKYYTYASTRNNLRLILRNLIENDFGVYYCATWDG

SEQ ID NO: 86469 - protein, 118 aa, Homo sapiens
  Payload ID: 17307
  Gene Symbol: TRGV3
  Gene Name: T cell receptor gamma variable 3
  ENSP ID: ENSP00000374869
MRWALLVLLAFLSPASQKSSNLEGRTKSVTRQTGSSAEITCDLTVTNTFYIHWYLHQEGKAPQRLLYYDVSTARDVLESGLSPGKYYTHTPRRWSWILRLQNLIENDSGVYYCATWDR

SEQ ID NO: 86470 - protein, 118 aa, Homo sapiens
  Payload ID: 17308
  Gene Symbol: TRGV4
  Gene Name: T cell receptor gamma variable 4
  ENSP ID: ENSP00000374868
MQWALAVLLAFLSPASQKSSNLEGRTKSVIRQTGSSAEITCDLAEGSTGYIHWYLHQEGKAPQRLLYYDSYTSSVVLESGISPGKYDTYGSTRKNLRMILRNLIENDSGVYYCATWDG

SEQ ID NO: 86471 - protein, 118 aa, Homo sapiens
  Payload ID: 17309
  Gene Symbol: TRGV5
  Gene Name: T cell receptor gamma variable 5
  ENSP ID: ENSP00000374867
MRWALLVLLAFLSPASQKSSNLEGGTKSVTRPTRSSAEITCDLTVINAFYIHWYLHQEGKAPQRLLYYDVSNSKDVLESGLSPGKYYTHTPRRWSWILILRNLIENDSGVYYCATWDR

SEQ ID NO: 86472 - protein, 119 aa, Homo sapiens
  Payload ID: 17309
  Gene Symbol: TRGV5
  Gene Name: T cell receptor gamma variable 5
  ENSP ID: ENSP00000483079
MRWALLVLLAFLSPASQKSSNLEGGTKSVTRPTRSSAEITCDLTVINAFYIHWYLHQEGKAPQRLLYYDVSNSKDVLESGLSPGKYYTHTPRRWSWILILRNLIENDSGVYYCATWDRH

SEQ ID NO: 86473 - protein, 118 aa, Homo sapiens
  Payload ID: 17310
  Gene Symbol: TRGV8
  Gene Name: T cell receptor gamma variable 8
  ENSP ID: ENSP00000374866
MLLALALLLAFLPPASQKSSNLEGRTKSVTRPTGSSAVITCDLPVENAVYTHWYLHQEGKAPQRLLYYDSYNSRVVLESGISREKYHTYASTGKSLKFILENLIERDSGVYYCATWDR

SEQ ID NO: 86474 - protein, 122 aa, Homo sapiens
  Payload ID: 17311
  Gene Symbol: TRGV9
  Gene Name: T cell receptor gamma variable 9
  ENSP ID: ENSP00000391561
MLSLLHTSTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEV

SEQ ID NO: 86475 - protein, 271 aa, Homo sapiens [sequence omitted]

SEQ ID NO: 86476 - protein, 279 aa, Homo sapiens [sequence omitted]

SEQ ID NO: 86477 - protein, 271 aa, Homo sapiens
  Payload ID: 17312
  Gene Symbol: TARM1
  Gene Name: T cell-interacting, activating receptor on myeloid cells 1
  ENSP ID: ENSP00000478234
MIPKLLSLLCFRLCVGQGDTRGDGSLPKPSLSAWPSSVVPANSNVTLRCWTPARGVSFVLRKGGIILESPKPLDSTEGAAEFHLNNLKVRNAGEYTCEYYRKASPHILSQRSDVLLLLVTGHLSKPFLRTYQRGTVTAGGRVTLQCQKRDQLFVPIMFALLKAGTPSPIQLQSPAGKEIDFSLVDVTAGDAGNYSCMYYQTKSPFWASEPSDQLEILVTVPPGTTSSNYSLGNFVRLGLAAVIVVIMGAFLVEAWYSRNVSPGESEAFKPE

SEQ ID NO: 86478 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  ENSP ID: ENSP00000478822

SEQ ID NO: 86479 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  ENSP ID: ENSP00000479062

SEQ ID NO: 86480 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  Uniprot ID: B6A8C7
  ENSP ID: ENSP00000479185

SEQ ID NO: 86481 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  ENSP ID: ENSP00000479374

SEQ ID NO: 86482 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  ENSP ID: ENSP00000479824

SEQ ID NO: 86483 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  Uniprot ID: B6A8C7
  ENSP ID: ENSP00000480049

SEQ ID NO: 86484 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  Uniprot ID: B6A8C7
  ENSP ID: ENSP00000480377

SEQ ID NO: 86485 - protein, 271 aa, Homo sapiens; identical to SEQ ID NO: 86477
  Payload ID: 17312
  Gene Symbol: TARM1
  Gene Name: T cell-interacting, activating receptor on myeloid cells 1
  ENSP ID: ENSP00000482624

SEQ ID NO: 86486 - protein, 279 aa, Homo sapiens
  Payload ID: 17312
  Gene Symbol: TARM1
  Gene Name: T cell-interacting, activating receptor on myeloid cells 1
  ENSP ID: ENSP00000484383
MKERKKKERKERKRKKERNGLCVGQGDTRGDGSLPKPSLSAWPSSVVPANSNVTLRCWTPARGVSFVLRKGGIILESPKPLDSTEGAAEFHLNNLKVRNAGEYTCEYYRKASPHILSQHSDVLLLLVTGHLSKPFLRTYQRGTVTAGGRVTLQCQKRDQLFVPIMFALLKAGTPSPIQLQSPAGKEIDFSLVDVTAGDAGNYSCMYYQTKSPFWASEPSDQLEILVTVPPGTTSSNYSLGNFVRLGLAAVIVVIMGAFLVEAWYSRNVSPGESEAFKPE

SEQ ID NO: 86487 - protein, 121 aa, Homo sapiens
  Payload ID: 17313
  Gene Symbol: TAC3
  Gene Name: tachykinin 3
  Uniprot ID: Q9UHF0
  ENSP ID: ENSP00000300108
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 86488 - protein, 135 aa, Homo sapiens
  Payload ID: 17313
  Gene Symbol: TAC3
  Gene Name: tachykinin 3
  Uniprot ID: Q9UHF0
  ENSP ID: ENSP00000350236
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPEGKTGPFLPSVRVPRPLHPNQLGSTGKSSLGTEEQRPL

SEQ ID NO: 86489 - protein, 103 aa, Homo sapiens
  Payload ID: 17313
  Gene Symbol: TAC3
  Gene Name: tachykinin 3
  Uniprot ID: Q9UHF0
  ENSP ID: ENSP00000368721
MRIMLLFTAILAFSLAQSFGAVCKEPQEEVVPGGGRSKRDPDLYQLLQRLFKSHSSLEGLLKALSQASTDPKESTSPEKHSPTDVNQENVPSFGILKYPPRAE

SEQ ID NO: 86490 - protein, 135 aa, Homo sapiens; identical to SEQ ID NO: 86488
  Payload ID: 17313
  Gene Symbol: TAC3
  Gene Name: tachykinin 3
  Uniprot ID: Q9UHF0
  ENSP ID: ENSP00000377445

SEQ ID NO: 86491 - protein, 121 aa, Homo sapiens; identical to SEQ ID NO: 86487
  Payload ID: 17313
  Gene Symbol: TAC3
  Gene Name: tachykinin 3
  Uniprot ID: Q9UHF0
  ENSP ID: ENSP00000402995

SEQ ID NO: 86492 - protein, 121 aa, Homo sapiens; identical to SEQ ID NO: 86487
  Payload ID: 17313
  Gene Symbol: TAC3
  Gene Name: tachykinin 3
  Uniprot ID: Q9UHF0
  ENSP ID: ENSP00000404056

SEQ ID NO: 86493 - protein, 135 aa, Homo sapiens; identical to SEQ ID NO: 86488
  Payload ID: 17313
  Gene Symbol: TAC3
  Gene Name: tachykinin 3
  Uniprot ID: Q9UHF0
  ENSP ID: ENSP00000408131

SEQ ID NO: 86494 - protein, 103 aa, Homo sapiens; identical to SEQ ID NO: 86489
  Payload ID: 17313
  Gene Symbol: TAC3
  Gene Name: tachykinin 3
  Uniprot ID: Q9UHF0
  ENSP ID: ENSP00000408208

SEQ ID NO: 86495 - protein, 103 aa, Homo sapiens; identical to SEQ ID NO: 86489
  Payload ID: 17313
  Gene Symbol: TAC3
  Gene Name: tachykinin 3
  Uniprot ID: Q9UHF0
  ENSP ID: ENSP00000416292

SEQ ID NO: 86496 - protein, 121 aa, Homo sapiens; identical to SEQ ID NO: 86487
  Payload ID: 17313
  Gene Symbol: TAC3
  Gene Name: tachykinin 3
  Uniprot ID: Q9UHF0
  ENSP ID: ENSP00000483110

SEQ ID NO: 86497 - protein, 87 aa, Homo sapiens
  Payload ID: 17314
  Gene Symbol: TAC4
  Gene Name: tachykinin 4 (hemokinin)
  Uniprot ID: Q86UU9
  ENSP ID: ENSP00000325286
MLPCLALLLLMELSVCTVAGDGGEEQTLSTEAETWEGAGPSIQLQLQEVKTGKASQFFGLMGKRVGGRPLIQPRRKKGREDEAQGSE

SEQ ID NO: 86498 - protein, 113 aa, Homo sapiens
  Payload ID: 17314
  Gene Symbol: TAC4
  Gene Name: tachykinin 4 (hemokinin)
  Uniprot ID: Q86UU9
  ENSP ID: ENSP00000334042
MLPCLALLLLMELSVCTVAGDGGEEQTLSTEAETWVIVALEEGAGPSIQLQLQEVKTGKASQFFGLMGKRVGGRPLIQPRRKKAYQLEHTFQGLLGKRSLFTEGREDEAQGSE

SEQ ID NO: 86499 - protein, 76 aa, Homo sapiens
  Payload ID: 17314
  Gene Symbol: TAC4
  Gene Name: tachykinin 4 (hemokinin)
  Uniprot ID: Q86UU9
  ENSP ID: ENSP00000340461
MLPCLALLLLMELSVCTVAGDGGEEQTLSTEAETWEGAGPSIQLQLQEVKTGKASQFFGLMGKRVGGREDEAQGSE

SEQ ID NO: 86500 - protein, 96 aa, Homo sapiens
  Payload ID: 17314
  Gene Symbol: TAC4
  Gene Name: tachykinin 4 (hemokinin)
  Uniprot ID: Q86UU9
  ENSP ID: ENSP00000381221
MLPCLALLLLMELSVCTVAGDGGEEQTLSTEAETWEGAGPSIQLQLQEVKTGKASQFFGLMGKRVGAYQLEHTFQGLLGKRSLFTEGREDEAQGSE

SEQ ID NO: 86501 - protein, 107 aa, Homo sapiens
  Payload ID: 17314
  Gene Symbol: TAC4
  Gene Name: tachykinin 4 (hemokinin)
  Uniprot ID: Q86UU9
  ENSP ID: ENSP00000399702
MLPCLALLLLMELSVCTVAGDGGEEQTLSTEAETWEGAGPSIQLQLQEVKTGKASQFFGLMGKRVGGRPLIQPRRKKAYQLEHTFQGLLGKRSLFTEGREDEAQGSE

SEQ ID NO: 86502 - protein, 53 aa, Homo sapiens
  Payload ID: 17314
  Gene Symbol: TAC4
  Gene Name: tachykinin 4 (hemokinin)
  ENSP ID: ENSP00000421777
MLPCLALLLLMELSVCTVAGDGGEEQTLSTEAETWVIVALEVLLGRGSDEGRG

SEQ ID NO: 86503 - protein, 407 aa, Homo sapiens
  Payload ID: 17315
  Gene Symbol: TACR1
  Gene Name: tachykinin receptor 1
  Uniprot ID: P25103
  ENSP ID: ENSP00000303522
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 86504 - protein, 311 aa, Homo sapiens
  Payload ID: 17315
  Gene Symbol: TACR1
  Gene Name: tachykinin receptor 1
  Uniprot ID: P25103
  ENSP ID: ENSP00000386448
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDR

SEQ ID NO: 86505 - protein, 398 aa, Homo sapiens
  Payload ID: 17316
  Gene Symbol: TACR2
  Gene Name: tachykinin receptor 2
  Uniprot ID: P21452
  ENSP ID: ENSP00000362403
MGTCDIVTEANISSGPESNTTGITAFSMPSWQLALWATAYLALVLVAVTGNAIVIWIILAHRRMRTVTNYFIVNLALADLCMAAFNAAFNFVYASHNIWYFGRAFCYFQNLFPITAMFVSIYSMTAIAADRYMAIVHPFQPRLSAPSTKAVIAGIWLVALALASPQCFYSTVTMDQGATKCVVAWPEDSGGKTLLLYHLVVIALIYFLPLAVMFVAYSVIGLTLWRRAVPGHQAHGANLRHLQAMKKFVKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 86506 - protein, 186 aa, Homo sapiens
  Payload ID: 17316
  Gene Symbol: TACR2
  Gene Name: tachykinin receptor 2
  ENSP ID: ENSP00000362404
MFVAYSVIGLTLWRRAVPGHQAHGANLRHLQAMKKFVKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 86507 - protein, 362 aa, Homo sapiens
  Payload ID: 17316
  Gene Symbol: TACR2
  Gene Name: tachykinin receptor 2
  ENSP ID: ENSP00000482436
MGTCDIVTEANISSGPESNTTGITAFSMRTVTNYFIVNLALADLCMAAFNAAFNFVYASHNIWYFGRAFCYFQNLFPITAMFVSIYSMTAIAADRYMAIVHPFQPRLSAPSTKAVIAGIWLVALALASPQCFYSTVTMDQGATKCVVAWPEDSGGKTLLLYHLVVIALIYFLPLAVMFVAYSVIGLTLWRRAVPGHQAHGANLRHLQAMKKFVKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 86508 - protein, 465 aa, Homo sapiens
  Payload ID: 17317
  Gene Symbol: TACR3
  Gene Name: tachykinin receptor 3
  Uniprot ID: P29371
  ENSP ID: ENSP00000303325
MATLPAAETWIDGGGGVGADAVNLTASLAAGAATGAVETGWLQLLDQAGNLSSSPSALGLPVASPAPSQPWANLTNQFVQPSWRIALWSLAYGVVVAVAVLGNLIVIWIILAHKRMRTVTNYFLVNLAFSDASMAAFNTLVNFIYALHSEWYFGANYCRFQNFFPITAVFASIYSMTAIAVDRYMAIIDPLKPRLSATATKIVIGSIWILAFLLAFPQCLYSKTKVMPGRTLCFVQWPEGPKQHFTYHIIVIILVYCFPLLIMGITYTIVGITLWGGEIPGDTCDKYHEQLKAKRKVVKMMIIVVMTFAICWLPYHIYFILTAIYQQLNRWKYIQQVYLASFWLAMSSTMYNPIIYCCLNKRFRAGFKRAFRWCPFIKVSSYDELELKTTRFHPNRQSSMYTVTRMESMTVVFDPNDADTTRSSRKKRATPRDPSFNGCSRRNSKSASATSSFISSPYTSVDEYS

SEQ ID NO: 86509 - protein, 114 aa, Homo sapiens
  Payload ID: 17318
  Gene Symbol: TAC1
  Gene Name: tachykinin, precursor 1
  Uniprot ID: P20366
  ENSP ID: ENSP00000289574
MKILVALAVFFLVSTQLFAEEIGANDDLNYWSDWYDSDQIKEELPEPFEHLLQRIARRPKPQQFFGLMGKRDAGHGQISHKRHKTDSFVGLMGKRALNSVAYERSAMQNYERRR

SEQ ID NO: 86510 - protein, 111 aa, Homo sapiens
  Payload ID: 17318
  Gene Symbol: TAC1
  Gene Name: tachykinin, precursor 1
  Uniprot ID: P20366
  ENSP ID: ENSP00000289576
MKILVALAVFFLVSTQLFAEEIGANDDLNYWSDWYDSDQIKEELPEPFEHLLQRIARRPKPQQFFGLMGKRDADSSIEKQVALLKALYGHGQISHKMAYERSAMQNYERRR

SEQ ID NO: 86511 - protein, 129 aa, Homo sapiens
  Payload ID: 17318
  Gene Symbol: TAC1
  Gene Name: tachykinin, precursor 1
  Uniprot ID: P20366
  ENSP ID: ENSP00000321106
MKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 86512 - protein, 1826 aa, Homo sapiens
  Payload ID: 17319
  Gene Symbol: TAF1L
  Gene Name: TAF1 RNA polymerase II, TATA box binding protein (TBP)-associated factor, 210kDa-like
  Uniprot ID: Q8IZX4
  ENSP ID: ENSP00000418379
MRPGCDLLLRAAATVTAAIMSDSDSEEDSSGGGPFTLAGILFGNISGAGQLEGESVLDDECKKHLAGLGALGLGSLITELTANEELTGTGGALVNDEGWIRSTEDAVDYSDINEVAEDESQRHQQTMGSLQPLYHSDYDEDDYDADCEDIDCKLMPPPPPPPGPMKKDKDQDAITCVSESGEDIILPSIIAPSFLASEKVDFSSYSDSESEMGPQEATQAESEDGKLTLPLAGIMQHDATKLLPSVTELFPEFRPGKVLRFLHLFGPGKNVPSVWRSARRKRKKHRELIQEEQIQEVECSVESEVSQKSLWNYDYAPPPPPEQCLADDEITMMVPVESKFSQSTGDVDKVTDTKPRVAEWRYGPARLWYDMLGVSEDGSGFDYGFKLRKTQHEPVIKSRMMEEFRKLEESNGTDLLADENFLMVTQLHWEDSIIWDGEDIKHKGTKPQGASLAGWLPSIKTRNVMAYNVQQGFAPTLDDDKPWYSIFPIDNEDLVYGRWEDNIIWDAQAMPRLLEPPVLALDPNDENLILEIPDEKEEATSNSPSKESKKESSLKKSRILLGKTGVIREEPQQNMSQPEVKDPWNLSNDEYYFPKQQGLRGTFGGNIIQHSIPAMELWQPFFPTHMGPIKIRQFHRPPLKKYSFGALSQPGPHSVQPLLKHIKKKAKMREQERQASGGGELFFMRTPQDLTGKDGDLILAEYSEENGPLMMQVGMATKIKNYYKRKPGKDPGAPDCKYGETVYCHTSPFLGSLHPGQLLQALENNLFRAPVYLHKMPETDFLIIRTRQGYYIRELVDIFVVGQQCPLFEVPGPNSRRANMHIRDFLQVFIYRLFWKSKDRPRRIRMEDIKKAFPSHSESSIRKRLKLCADFKRTGMDSNWWVLKSDFRLPTEEEIRAKVSPEQCCAYYSMIAAKQRLKDAGYGEKSFFAPEEENEEDFQMKIDDEVHAAPWNTTRAFIAAMKGKCLLEVTGVADPTGCGEGFSYVKIPNKPTQQKDDKEPQAVKKTVTGTDADLRRLSLKNAKQLLRKFGVPEEEIKKLSRWEVIDVVRTMSTEQAHSGEGPMSKFARGSRFSVAEHQERYKEECQRIFDLQNKVLSSTEVLSTDTDSISAEDSDFEEMGKNIENMLQNKKTSSQLSREWEEQERKELRRMLLVAGSAASGNNHRDDVTASMTSLKSSATGHCLKIYRTFRDEEGKEYVRCETVRKPAVIDAYVRIRTTKDEKFIQKFALFDEKHREEMRKERRRIQEQLRRLKRNQEKEKLKGPPEKKPKKMKERPDLKLKCGACGAIGHMRTNKFCPLYYQTNVPPSKPVAMTEEQEEELEKTVIHNDNEELIKVEGTKIVFGKQLIENVHEVRRKSLVLKFPKQQLPPKKKRRVGTTVHCDYLNIPHKSIHRRRTDPMVTLSSILESIINDMRDLPNTHPFHTPVNAKVVKDYYKIITRPMDLQTLRENVRKCLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKMIVNPVDLETIRKNISKHKYQSRESFLDDVNLILANSVKYNGPESQYTKTAQEIVNICYQTITEYDEHLTQLEKDICTAKEAALEEAELESLDPMTPGPYTSQPPDMYDTNTSLSTSRDASVFQDESNLSVLDISTATPEKQMCQGQGRLGEEDSDVDVEGYDDEEEDGKPKPPAPEGGDGDLADEEEGTVQQPEASVLYEDLLISEGEDDEEDAGSDEEGDNPFSAIQLSESGSDSDVGYGGIRPKQPFMLQHASGEHKDGHGK

SEQ ID NO: 86513 - protein, 1893 aa, Homo sapiens
  Payload ID: 17320
  Gene Symbol: TAF1
  Gene Name: TAF1 RNA polymerase II, TATA box binding protein (TBP)-associated factor, 250kDa
  Uniprot ID: P21675
  ENSP ID: ENSP00000276072
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 86514 - protein, 458 aa, Homo sapiens
  Payload ID: 17320
  Gene Symbol: TAF1
  Gene Name: TAF1 RNA polymerase II, TATA box binding protein (TBP)-associated factor, 250kDa
  ENSP ID: ENSP00000362880
  MOD_RES (1)..(1): Any amino acid
XKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQAKPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNIRYQ

SEQ ID NO: 86515 - protein, 1872 aa, Homo sapiens
  Payload ID: 17320
  Gene Symbol: TAF1
  Gene Name: TAF1 RNA polymerase II, TATA box binding protein (TBP)-associated factor, 250kDa
  Uniprot ID: P21675
  ENSP ID: ENSP00000362895
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 86516 - protein, 490 aa, Homo sapiens
  Payload ID: 17320
  Gene Symbol: TAF1
  Gene Name: TAF1 RNA polymerase II, TATA box binding protein (TBP)-associated factor, 250kDa
  ENSP ID: ENSP00000406517
  MOD_RES (1)..(1): Any amino acid
XKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQMRQGRGRLGEEDSDVDIEGYDDEEEDGKPKTPAPEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNIRYQ

SEQ ID NO: 86517 - protein, 1895 aa, Homo sapiens
  Payload ID: 17320
  Gene Symbol: TAF1
  Gene Name: TAF1 RNA polymerase II, TATA box binding protein (TBP)-associated factor, 250kDa
  Uniprot ID: P21675
  ENSP ID: ENSP00000406549
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQAKPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 86518 - protein, 150 aa, Homo sapiens
  Payload ID: 17320
  Gene Symbol: TAF1
  Gene Name: TAF1 RNA polymerase II, TATA box binding protein (TBP)-associated factor, 250kDa
  ENSP ID: ENSP00000421611
  MOD_RES (1)..(1): Any amino acid
XVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGIGIRIKHTRSIEKGHSHHHLPRE

SEQ ID NO: 86519 - protein, 279 aa, Homo sapiens
  Payload ID: 17320
  Gene Symbol: TAF1
  Gene Name: TAF1 RNA polymerase II, TATA box binding protein (TBP)-associated factor, 250kDa
  ENSP ID: ENSP00000424526
  MOD_RES (1)..(1): Any amino acid
XSSAEDSDFEEMGKNIENMLQNKKTSSQLSREREEQERKELQRMLLAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLN

SEQ ID NO: 86520 - protein, 218 aa, Homo sapiens
  Payload ID: 17321
  Gene Symbol: TAF10
  Gene Name: TAF10 RNA polymerase II, TATA box binding protein (TBP)-associated factor, 30kDa
  Uniprot ID: Q12962
  ENSP ID: ENSP00000299424
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTIPDAVTGYYLNRAGFEASDPRIIRLISLAAQKFISDIANDALQHCKMKGTASGSSRSKSKDRKYTLTMEDLTPALSEYGINVKKPHYFT

SEQ ID NO: 86521 - protein, 115 aa, Homo sapiens
  Payload ID: 17321
  Gene Symbol: TAF10
  Gene Name: TAF10 RNA polymerase II, TATA box binding protein (TBP)-associated factor, 30kDa
  ENSP ID: ENSP00000480402
AASAPGPAPPVSAPAALPSSTAAENKIPDAVTGYYLNRAGFEASDPRIIRLISLAAQKFISDIANDALQHCKMKGTASGSSRSKSKDRKYTLTMEDLTPALSEYGINVKKPHYFT

SEQ ID NO: 86522 - protein, 211 aa, Homo sapiens
  Payload ID: 17322
  Gene Symbol: TAF11
  Gene Name: TAF11 RNA polymerase II, TATA box binding protein (TBP)-associated factor, 28kDa
  Uniprot ID: Q15544
  ENSP ID: ENSP00000354633
MDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRLIQSITGTSVSQNVVIAMSGISKVFVGEVVEEALDVCEKWGEMPPLQPKHMREAVRRLKSKGQIPNSKHKKIIFF

SEQ ID NO: 86523 - protein, 154 aa, Homo sapiens
  Payload ID: 17322
  Gene Symbol: TAF11
  Gene Name: TAF11 RNA polymerase II, TATA box binding protein (TBP)-associated factor, 28kDa
  Uniprot ID: Q15544
  ENSP ID: ENSP00000408121
MDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRHWMCVRSGEKCHHYNPNI

SEQ ID NO: 86524 - protein, 161 aa, Homo sapiens
  Payload ID: 17323
  Gene Symbol: TAF12
  Gene Name: TAF12 RNA polymerase II, TATA box binding protein (TBP)-associated factor, 20kDa
  Uniprot ID: Q16514
  ENSP ID: ENSP00000263974
MNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQRMALIRKTTKK

SEQ ID NO: 86525 - protein, 161 aa, Homo sapiens; identical to SEQ ID NO: 86524
  Payload ID: 17323
  Gene Symbol: TAF12
  Gene Name: TAF12 RNA polymerase II, TATA box binding protein (TBP)-associated factor, 20kDa
  Uniprot ID: Q16514
  ENSP ID: ENSP00000362930

SEQ ID NO: 86526 - protein, 124 aa, Homo sapiens
  Payload ID: 17324
  Gene Symbol: TAF13
  Gene Name: TAF13 RNA polymerase II, TATA box binding protein (TBP)-associated factor, 18kDa
  Uniprot ID: Q15543
  ENSP ID: ENSP00000355051
MADEEEDPTFEEENEEIGGGAEGGQGKRKRLFSKELRCMMYGFGDDQNPYTESVDILEDLVIEFITEMTHKAMSIGRQGRVQVEDIVFLIRKDPRKFARVKDLLTMNEELKRARKAFDEANYGS

SEQ ID NO: 86527 - protein, 124 aa, Homo sapiens; identical to SEQ ID NO: 86526
  Payload ID: 17324
  Gene Symbol: TAF13
  Gene Name: TAF13 RNA polymerase II, TATA box binding protein (TBP)-associated factor, 18kDa
  Uniprot ID: Q15543
  ENSP ID: ENSP00000433883

SEQ ID NO: 86528 - protein, 102 aa, Homo sapiens
  Payload ID: 17325
  Gene Symbol: TAF15
  Gene Name: TAF15 RNA polymerase II, TATA box binding protein (TBP)-associated factor, 68kDa
  ENSP ID: ENSP00000474047
SGGYGGDRSGGGYGGDRGGGYGGDRGGYGGKMGGRSSCSSKRPRTWDGSCCTVVAVSLLDLTRHPSTPGSLVCAHMPHISDPVSFFPELQQFSDSPPAVVPP

SEQ ID NO: 86529 - protein, 592 aa, Homo sapiens
  Payload ID: 17325
  Gene Symbol: TAF15
  Gene Name: TAF15 RNA polymerase II, TATA box binding protein (TBP)-associated factor, 68kDa
  Uniprot ID: Q92804
  ENSP ID: ENSP00000474096
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 86530 - protein, 32 aa, Homo sapiens
  Payload ID: 17325
  Gene Symbol: TAF15
  Gene Name: TAF15 RNA polymerase II, TATA box binding protein (TBP)-associated factor, 68kDa
  ENSP ID: ENSP00000474436
MESSGSQGGRAPSYDQPDYGQQDSYDQQSGYD

SEQ ID NO: 86531 - protein, 449 aa, Homo sapiens
  Payload ID: 17325
  Gene Symbol: TAF15
  Gene Name: TAF15 RNA polymerase II, TATA box binding protein (TBP)-associated factor, 68kDa
  ENSP ID: ENSP00000474522
MESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRTGGAMEETVVVAVATVETEVEAMEETGVVAAMEETEVGATEETEVAMEAKWEEETTTEMISATDHTDDCFECSFVSDMIHSEIARVLPAAFLVASSWVVKLSDIWIFIWVGGLGQFFF

SEQ ID NO: 86532 - protein, 589 aa, Homo sapiens
  Payload ID: 17325
  Gene Symbol: TAF15
  Gene Name: TAF15 RNA polymerase II, TATA box binding protein (TBP)-associated factor, 68kDa
  Uniprot ID: Q92804
  ENSP ID: ENSP00000474609
MSDSGSYGQSGGEQQSYSTYGNPGSQGYGQASQSYSGYGQTTDSSYGQNYSGYSSYGQSYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 86533 - protein, 121 aa, Homo sapiens
  Payload ID: 17325
  Gene Symbol: TAF15
  Gene Name: TAF15 RNA polymerase II, TATA box binding protein (TBP)-associated factor, 68kDa
  ENSP ID: ENSP00000474653
MESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSRSQGLWTQNRC

SEQ ID NO: 86534 - protein, 239 aa, Homo sapiens
  Payload ID: 17325
  Gene Symbol: TAF15
  Gene Name: TAF15 RNA polymerase II, TATA box binding protein (TBP)-associated factor, 68kDa
  ENSP ID: ENSP00000475044
MSDSGSYGQSGGEQQSYSTYGNPGSQGYGQASQSYSGYGQTTDSSYGQNYSGYSSYGQSYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLG

SEQ ID NO: 86535 - protein, 214 aa, Homo sapiens
  Payload ID: 17325
  Gene Symbol: TAF15
  Gene Name: TAF15 RNA polymerase II, TATA box binding protein (TBP)-associated factor, 68kDa
  ENSP ID: ENSP00000475147
  MOD_RES (1)..(1): Any amino acid
XRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRSRGGYGGDRGGGSGYGGDRSGGYGGDRSGGGYGGDRGGGYGGDRGGYGGKMGGRNDYRNDQRNRPY

SEQ ID NO: 86536 - protein, 592 aa, Homo sapiens; identical to SEQ ID NO: 86529
  Payload ID: 17325
  Gene Symbol: TAF15
  Gene Name: TAF15 RNA polymerase II, TATA box binding protein (TBP)-associated factor, 68kDa
  Uniprot ID: Q92804
  ENSP ID: ENSP00000480040

SEQ ID NO: 86537 - protein, 32 aa, Homo sapiens; identical to SEQ ID NO: 86530
  Payload ID: 17325
  Gene Symbol: TAF15
  Gene Name: TAF15 RNA polymerase II, TATA box binding protein (TBP)-associated factor, 68kDa
  ENSP ID: ENSP00000487917

SEQ ID NO: 86538 - protein, 121 aa, Homo sapiens; identical to SEQ ID NO: 86533
  Payload ID: 17325
  Gene Symbol: TAF15
  Gene Name: TAF15 RNA polymerase II, TATA box binding protein (TBP)-associated factor, 68kDa
  ENSP ID: ENSP00000487975

SEQ ID NO: 86539 - protein, 102 aa, Homo sapiens; identical to SEQ ID NO: 86528
  Payload ID: 17325
  Gene Symbol: TAF15
  Gene Name: TAF15 RNA polymerase II, TATA box binding protein (TBP)-associated factor, 68kDa
  ENSP ID: ENSP00000488590

SEQ ID NO: 86540 - protein, 214 aa, Homo sapiens; identical to SEQ ID NO: 86535
  Payload ID: 17325
  Gene Symbol: TAF15
  Gene Name: TAF15 RNA polymerase II, TATA box binding protein (TBP)-associated factor, 68kDa
  ENSP ID: ENSP00000488608
  MOD_RES (1)..(1): Any amino acid

SEQ ID NO: 86541 - protein, 239 aa, Homo sapiens; identical to SEQ ID NO: 86534
  Payload ID: 17325
  Gene Symbol: TAF15
  Gene Name: TAF15 RNA polymerase II, TATA box binding protein (TBP)-associated factor, 68kDa
  ENSP ID: ENSP00000488655

SEQ ID NO: 86542 - protein, 589 aa, Homo sapiens; identical to SEQ ID NO: 86532
  Payload ID: 17325
  Gene Symbol: TAF15
  Gene Name: TAF15 RNA polymerase II, TATA box binding protein (TBP)-associated factor, 68kDa
  Uniprot ID: Q92804
  ENSP ID: ENSP00000488684

SEQ ID NO: 86543 - protein, 449 aa, Homo sapiens; identical to SEQ ID NO: 86531
  Payload ID: 17325
  Gene Symbol: TAF15
  Gene Name: TAF15 RNA polymerase II, TATA box binding protein (TBP)-associated factor, 68kDa
  ENSP ID: ENSP00000488803

SEQ ID NO: 86544 - protein, 1199 aa, Homo sapiens
  Payload ID: 17326
  Gene Symbol: TAF2
  Gene Name: TAF2 RNA polymerase II, TATA box binding protein (TBP)-associated factor, 150kDa
  Uniprot ID: Q6P1X5
  ENSP ID: ENSP00000367406
MPLTGVEPARMNRKKGDKGFESPRPYKLTHQVVCINNINFQRKSVVGFVELTIFPTVANLNRIKLNSKQCRIYRVRINDLEAAFIYNDPTLEVCHSESKQRNLNYFSNAYAAAVSAVDPDAGNGELCIKVPSELWKHVDELKVLKIHINFSLDQPKGGLHFVVPSVEGSMAERGAHVFSCGYQNSTRFWFPCVDSYSELCTWKLEFTVDAAMVAVSNGDLVETVYTHDMRKKTFHYMLTIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWVLKGISGYIYGLWMKKTFGVNEYRHWIKEELDKIVAYELKTGGVLLHPIFGGGKEKDNPASHLHFSIKHPHTLSWEYYSMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQADFMWQYQLRYERDVVAQQESILALEKFPTPASRLALTDILEQEQCFYRVRMSACFCLAKIANSMVSTWTGPPAMKSLFTRMFCCKSCPNIVKTNNFMSFQSYFLQKTMPVAMALLRDVHNLCPKEVLTFILDLIKYNDNRKNKFSDNYYRAEMIDALANSVTPAVSVNNEVRTLDNLNPDVRLILEEITRFLNMEKLLPSYRHTITVSCLRAIRVLQKNGHVPSDPALFKSYAEYGHFVDIRIAALEAVVDYTKVDRSYEELQWLLNMIQNDPVPYVRHKILNMLTKNPPFTKNMESPLCNEALVDQLWKLMNSGTSHDWRLRCGAVDLYFTLFGLSRPSCLPLPELGLVLNLKEKKAVLNPTIIPESVAGNQEAANNPSSHPQLVGFQNPFSSSQDEEEIDMDTVHDSQAFISHHLNMLERPSTPGLSKYRPASSRSALIPQHSAGCDSTPTTKPQWSLELARKGTGKEQAPLEMSMHPAASAPLSVFTKESTASKHSDHHHHHHHEHKKKKKKHKHKHKHKHKHDSKEKDKEPFTFSSPASGRSIRSPSLSD

SEQ ID NO: 86545 - protein, 60 aa, Homo sapiens
  Payload ID: 17326
  Gene Symbol: TAF2
  Gene Name: TAF2 RNA polymerase II, TATA box binding protein (TBP)-associated factor, 150kDa
  ENSP ID: ENSP00000428484
MPLTGVEPARMNRKKGDKGFESPRPYKLTHQVVCINNINFQRKSVVEKPQLFFQCLCSCS

SEQ ID NO: 86546 - protein, 67 aa, Homo sapiens
  Payload ID: 17326
  Gene Symbol: TAF2
  Gene Name: TAF2 RNA polymerase II, TATA box binding protein (TBP)-associated factor, 150kDa
  ENSP ID: ENSP00000428690
  MOD_RES (1)..(1): Any amino acid
XNEVRTLDNLNPDVRLILEEITRFLNMEKLLPSYRHTITVRLECSGAILAHHNLHLLGSSDSPASAS

SEQ ID NO: 86547 - protein, 285 aa, Homo sapiens
  Payload ID: 17326
  Gene Symbol: TAF2
  Gene Name: TAF2 RNA polymerase II, TATA box binding protein (TBP)-associated factor, 150kDa
  ENSP ID: ENSP00000430832
  MOD_RES (1)..(1): Any amino acid
XPQLLPLLKHTTSYLHEVFEFYEEILTCRYPYSCFKTVFIDEAYVEVAAYASMSIFRSDEWVLKGISGYIYGLWMKKTFGVNEYRHWIKEELDKIVAYELKTGGVLLHPIFGGGKEKDNPASHLHFSIKHPHTLSWEYYSMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPC

SEQ ID NO: 86548 - protein, 375 aa, Homo sapiens [sequence omitted]

SEQ ID NO: 86549 - protein, 929 aa, Homo sapiens
  Payload ID: 17327
  Gene Symbol: TAF3
  Gene Name: TAF3 RNA polymerase II, TATA box binding protein (TBP)-associated factor, 140kDa
  Uniprot ID: Q5VWG9
  ENSP ID: ENSP00000340271
MCESYSRSLLRVSVAQICQALGWDSVQLSACHLLTDVLQRYLQQLGRGCHRYSELYGRTDPILDDVGEAFQLMGVSLHELEDYIHNIEPVTFPHQIPSFPVSKNNVLQFPQPGSKDAEERKEYIPDYLPPIVSSQEEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKTSSPGQKTKSPKTAQSPAMVGSPIRSPKTVSKEKKSPGRSKSPKSPKSPKVTTHIPQTPVRPETPNRTPSATLSEKISKETIQVKQIQTPPDAGKLNSENQPKKAVVADKTIEASIDAVIARACAEREPDPFEFSSGSESEGDIFTSPKRISGPECTTPKASTSANNFTKSGSTPLPLSGGTSSSDNSWTMDASIDEVVRKAKLGTPSNMPPNFPYISSPSVSPPTPEPLHKVYEEKTKLPSSVEVKKKLKKELKTKMKKKEKQRDREREKDKNKDKSKEKDKVKEKEKDKETGRETKYPWKEFLKEEEADPYKFKIKEFEDVDPKVKLKDGLVRKEKEKHKDKKKDREKGKKDKDKREKEKVKDKGREDKMKAPAPPLVLPPKELALPLFSPATASRVPAMLPSLLPVLPEKLFEEKEKVKEKEKKKDKKEKKKKKEKEKEKKEKEREKEKREREKREKEKEKHKHEKIKVEPVALAPSPVIPRLTLRVGAGQDKIVISKVVPAPEAKPAPSQNRPKTPPPAPAPAPGPMLVSPAPVPLPLLAQAAAGPALLPSPGPAASGASAKAPVRSVVTETVSTYVIRDEWGNQIWICPGCNKPDDGSPMIGCDDCDDWYHWPCVGIMTAPPEEMQWFCPKCANKKKDKKHKKRKHRAH

SEQ ID NO: 86550 - protein, 1085 aa, Homo sapiens
  Payload ID: 17328
  Gene Symbol: TAF4
  Gene Name: TAF4 RNA polymerase II, TATA box binding protein (TBP)-associated factor, 135kDa
  Uniprot ID: O00268
  ENSP ID: ENSP00000252996
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGSCAPVPAAAAVAAGPEPAPAGPAKPAGPAALAARAGPGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 86551 - protein, 79 aa, Homo sapiens
  Payload ID: 17328
  Gene Symbol: TAF4
  Gene Name: TAF4 RNA polymerase II, TATA box binding protein (TBP)-associated factor, 135kDa
  ENSP ID: ENSP00000476270
  MOD_RES (1)..(1): Any amino acid
XSRQEDPEQLRLKQKAKEMQQQELAQMRQRDANLTALAAIGPRKKRKVDCPGPGSGAEASVALSKQRAQGERPGWSPCR

SEQ ID NO: 86552 - protein, 215 aa, Homo sapiens
  Payload ID: 17328
  Gene Symbol: TAF4
  Gene Name: TAF4 RNA polymerase II, TATA box binding protein (TBP)-associated factor, 135kDa
  ENSP ID: ENSP00000476294
VPFLKRSLPALRQLTPDSAAFIQQSQQQPPPPTSQATTALTAVVLSSSVQRTAGKTAATVTSALQPPVLSLTQPTQVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQR

SEQ ID NO: 86553 - protein, 215 aa, Homo sapiens; identical to SEQ ID NO: 86552
  Payload ID: 17328
  Gene Symbol: TAF4
  Gene Name: TAF4 RNA polymerase II, TATA box binding protein (TBP)-associated factor, 135kDa
  ENSP ID: ENSP00000486663

SEQ ID NO: 86554 - protein, 79 aa, Homo sapiens; identical to SEQ ID NO: 86551
  Payload ID: 17328
  Gene Symbol: TAF4
  Gene Name: TAF4 RNA polymerase II, TATA box binding protein (TBP)-associated factor, 135kDa
  ENSP ID: ENSP00000486972
  MOD_RES (1)..(1): Any amino acid

SEQ ID NO: 86555 - protein, 457 aa, Homo sapiens
  Payload ID: 17328
  Gene Symbol: TAF4
  Gene Name: TAF4 RNA polymerase II, TATA box binding protein (TBP)-associated factor, 135kDa
  ENSP ID: ENSP00000487182
DGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 86556 - protein, 862 aa, Homo sapiens
  Payload ID: 17329
  Gene Symbol: TAF4B
  Gene Name: TAF4b RNA polymerase II, TATA box binding protein (TBP)-associated factor, 105kDa
  Uniprot ID: Q92750
  ENSP ID: ENSP00000269142
MPAGLTEPAGAAPPAAVSASGTVTMAPAGALPVRVESTPVALGAVTKAPVSVCVEPTASQPLRSPVGTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVSSAGTTSDKPVIGTPVQIKLAQPGPVLSQPAGIPQAVQVKQLVVQQPSGGNEKQVTTISHSSTLTIQKCGQKTMPVNTIIPTSQFPPASILKQITLPGNKILSLQASPTQKNRIKENVTSCFRDEDDINDVTSMAGVNLNEENACILATNSELVGTLIQSCKDEPFLFIGALQKRILDIGKKHDITELNSDAVNLISQATQERLRGLLEKLTAIAQHRMTTYKASENYILCSDTRSQLKFLEKLDQLEKQRKDLEEREMLLKAAKSRSNKEDPEQLRLKQKAKELQQLELAQIQHRDANLTALAAIGPRKKRPLESGIEGLKDNLLASGTSSLTATKQLHRPRITRICLRDLIFCMEQEREMKYSRALYLALLK

SEQ ID NO: 86557 - protein, 865 aa, Homo sapiens
  Payload ID: 17329
  Gene Symbol: TAF4B
  Gene Name: TAF4b RNA polymerase II, TATA box binding protein (TBP)-associated factor, 105kDa
  ENSP ID: ENSP00000383314
MPAGLTEPAGAAPPAAVSASGTVTMAPAGALPVRVESTPVALGAVTKAPVSVCVEPTASQPLRSPVGTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVFCWDHIKPVIGTPVQIKLAQPGPVLSQPAGIPQAVQVKQLFSLFQVVQQPSGGNEKQVTTISHSSTLTIQKCGQKTMPVNTIIPTSQFPPASILKQITLPGNKILSLQASPTQKNRIKENVTSCFRDEDDINDVTSMAGVNLNEENACILATNSELVGTLIQSCKDEPFLFIGALQKRILDIGKKHDITELNSDAVNLISQATQERLRGLLEKLTAIAQHRMTTYKASENYILCSDTRSQLKFLEKLDQLEKQRKDLEEREMLLKAAKSRSNKEDPEQLRLKQKAKELQQLELAQIQHRDANLTALAAIGPRKKRPLESGIEGLKDNLLASGTSSLTATKQLHRPRITRICLRDLIFCMEQEREMKYSRALYLALLK

SEQ ID NO: 86558 - protein, 618 aa, Homo sapiens
  Payload ID: 17329
  Gene Symbol: TAF4B
  Gene Name: TAF4b RNA polymerase II, TATA box binding protein (TBP)-associated factor, 105kDa
  Uniprot ID: Q92750
  ENSP ID: ENSP00000389365
MPAGLTEPAGAAPPAAVSASGTVTMAPAGALPVRVESTPVALGAVTKAPVSVCVEPTASQPLRSPVGTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVSSAGTTSDKPVIGTPVQIKLAQPGPVLSQPAGIPQAVQVKQLVVQQPSGGNEKQVTTISHSSTLTIQKCGQKTMPVNTIIPTSQFPPASILKQITLPGNKILSLQASPTQKNRIKENVTSCFRSTFICVY

SEQ ID NO: 86559 - protein, 867 aa, Homo sapiens
  Payload ID: 17329
  Gene Symbol: TAF4B
  Gene Name: TAF4b RNA polymerase II, TATA box binding protein (TBP)-associated factor, 105kDa
  ENSP ID: ENSP00000462980
MPAGLTEPAGAAPPAAVSASGTVTMAPAGALPVRVESTPVALGAVTKAPVSVCVEPTASQPLRSPVGTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVSSAGTTSDKPVIGTPVQIKLAQPGPVLSQPAGIPQAVQVKQLFSLFQVVQQPSGGNEKQVTTISHSSTLTIQKCGQKTMPVNTIIPTSQFPPASILKQITLPGNKILSLQASPTQKNRIKENVTSCFRDEDDINDVTSMAGVNLNEENACILATNSELVGTLIQSCKDEPFLFIGALQKRILDIGKKHDITELNSDAVNLISQATQERLRGLLEKLTAIAQHRMTTYKASENYILCSDTRSQLKFLEKLDQLEKQRKDLEEREMLLKAAKSRSNKEDPEQLRLKQKAKELQQLELAQIQHRDANLTALAAIGPRKKRPLESGIEGLKDNLLASGTSSLTATKQLHRPRITRICLRDLIFCMEQEREMKYSRALYLALLK

SEQ ID NO: 86560 - protein, 800 aa, Homo sapiens
  Payload ID: 17330
  Gene Symbol: TAF5
  Gene Name: TAF5 RNA polymerase II, TATA box binding protein (TBP)-associated factor, 100kDa
  Uniprot ID: Q15542
  ENSP ID: ENSP00000358854
MAALAEEQTEVAVKLEPEGPPTLLPPQAGDGAGEGSGGTTNNGPNGGGGNVAASSSTGGDGGTPKPTVAVSAAAPAGAAPVPAAAPDAGAPHDRQTLLAVLQFLRQSKLREAEEALRREAGLLEEAVAGSGAPGEVDSAGAEVTSALLSRVTASAPGPAAPDPPGTGASGATVVSGSASGPAAPGKVGSVAVEDQPDVSAVLSAYNQQGDPTMYEEYYSGLKHFIECSLDCHRAELSQLFYPLFVHMYLELVYNQHENEAKSFFEKFHGDQECYYQDDLRVLSSLTKKEHMKGNETMLDFRTSKFVLRISRDSYQLLKRHLQEKQNNQIWNIVQEHLYIDIFDGMPRSKQQIDAMVGSLAGEAKREANKSKVFFGLLKEPEIEVPLDDEDEEGENEEGKPKKKKPKKDSIGSKSKKQDPNAPPQNRIPLPELKDSDKLDKIMNMKETTKRVRLGPDCLPSICFYTFLNAYQGLTAVDVTDDSSLIAGGFADSTVRVWSVTPKKLRSVKQASDLSLIDKESDDVLERIMDEKTASELKILYGHSGPVYGASFSPDRNYLLSSSEDGTVRLWSLQTFTCLVGYKGHNYPVWDTQFSPYGYYFVSGGHDRVARLWATDHYQPLRIFAGHLADVNCTRFHPNSNYVATGSADRTVRLWDVLNGNCVRIFTGHKGPIHSLTFSPNGRFLATGATDGRVLLWDIGHGLMVGELKGHTDTVCSLRFSRDGEILASGSMDNTVRLWDAIKAFEDLETDDFTTATGHINLPENSQELLLGTYMTKSTPVVHLHFTRRNLVLAAGAYSPQ

SEQ ID NO: 86561 - protein, 589 aa, Homo sapiens
  Payload ID: 17331
  Gene Symbol: TAF5L
  Gene Name: TAF5-like RNA polymerase II, p300/CBP-associated factor (PCAF)-associated factor, 65kDa
  Uniprot ID: O75529
  ENSP ID: ENSP00000258281
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDVQPAKRTDYQLYASGSSSRSENNGLEPPDMPSPILQNEAALEVLQESIKRVKDGPPSLTTICFYAFYNTEQLLNTAEISPDSKLLAAGFDNSCIKLWSLRSKKLKSEPHQVDVSRIHLACDILEEEDDEDDNAGTEMKILRGHCGPVYSTRFLADSSGLLSCSEDMSIRYWDLGSFTNTVLYQGHAYPVWDLDISPYSLYFASGSHDRTARLWSFDRTYPLRIYAGHLADVDCVKFHPNSNYLATGSTDKTVRLWSAQQGNSVRLFTGHRGPVLSLAFSPNGKYLASAGEDQRLKLWDLASGTLYKELRGHTDNITSLTFSPDSGLIASASMDNSVRVWDIRNTYCSAPADGSSSELVGVYTGQMSNVLSVQFMACNLLLVTGITQENQEH

SEQ ID NO: 86562 - protein, 84 aa, Homo sapiens
  Payload ID: 17331
  Gene Symbol: TAF5L
  Gene Name: TAF5-like RNA polymerase II, p300/CBP-associated factor (PCAF)-associated factor, 65kDa
  ENSP ID: ENSP00000355634
MKRVRTEQIQMAVSCYLKRRQYVDSDGPLKQGLRLSQTAEEMAANLTGNGGGSSGGVSLEQENSRQYPCGITSPLLKTVPERAD

SEQ ID NO: 86563 - protein, 325 aa, Homo sapiens
  Payload ID: 17331
  Gene Symbol: TAF5L
  Gene Name: TAF5-like RNA polymerase II, p300/CBP-associated factor (PCAF)-associated factor, 65kDa
  Uniprot ID: O75529
  ENSP ID: ENSP00000355635
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDVQPAKRTDYQLYASGSSSRSENNGLEPPDMPSPILQNEAALEVLQESIKRVKDGPPSLTTICFYAFYNTEQLLNTAEISPDSKLLAAGFDNSCIKLWSLRSKKLKSEPHQVDVSRIHLACDILEEEV

SEQ ID NO: 86564 - protein, 589 aa, Homo sapiens; identical to SEQ ID NO: 86561
  Payload ID: 17331
  Gene Symbol: TAF5L
  Gene Name: TAF5-like RNA polymerase II, p300/CBP-associated factor (PCAF)-associated factor, 65kDa
  Uniprot ID: O75529
  ENSP ID: ENSP00000355636

SEQ ID NO: 86565 - protein, 677 aa, Homo sapiens
  Payload ID: 17332
  Gene Symbol: TAF6
  Gene Name: TAF6 RNA polymerase II, TATA box binding protein (TBP)-associated factor, 80kDa
  Uniprot ID: P49848
  ENSP ID: ENSP00000344537
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 86566 - protein, 677 aa, Homo sapiens; identical to SEQ ID NO: 86565
  Payload ID: 17332
  Gene Symbol: TAF6
  Gene Name: TAF6 RNA polymerase II, TATA box binding protein (TBP)-associated factor, 80kDa
  Uniprot ID: P49848
  ENSP ID: ENSP00000389575

SEQ ID NO: 86567 - protein, 134 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000390073
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAH

SEQ ID NO: 86568 - protein, 76 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000390220
MAEEKKLKLSNTVLPSESMKVVAESMGIAQIQEETCQLLTDEVSYRIKEIAQDALKFMHMGKRQKLTTSDIDYALK

SEQ ID NO: 86569 - protein, 13 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000395627
MAEEKKLKLSNTV

SEQ ID NO: 86570 - protein, 714 aa, Homo sapiens
  Payload ID: 17332
  Gene Symbol: TAF6
  Gene Name: TAF6 RNA polymerase II, TATA box binding protein (TBP)-associated factor, 80kDa
  Uniprot ID: P49848
  ENSP ID: ENSP00000399982
MTKRRLQTITACLQLREGSPSLHRGLHPSREEKRDSRMAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 86571 - protein, 114 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000406315
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDL

SEQ ID NO: 86572 - protein, 232 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000410012
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPG

SEQ ID NO: 86573 - protein, 156 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000412346
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAPKEQQKAEATEPLKSAKPGQEED

SEQ ID NO: 86574 - protein, 114 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000413614
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKELIG

SEQ ID NO: 86575 - protein, 677 aa, Homo sapiens; identical to SEQ ID NO: 86565
  Payload ID: 17332
  Gene Symbol: TAF6
  Gene Name: TAF6 RNA polymerase II, TATA box binding protein (TBP)-associated factor, 80kDa
  Uniprot ID: P49848
  ENSP ID: ENSP00000416396

SEQ ID NO: 86576 - protein, 255 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000419555
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQM

SEQ ID NO: 86577 - protein, 734 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000419760
MDIRHSEFLPCLHCPPFVGPLPVSHVSFSSACPVPLPGSPSLHRGLHPSREEKRDSRMAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 86578 - protein, 9 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000427710
MAEEKKLKL

SEQ ID NO: 86579 - protein, 113 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000428071
MAEEKKLKLSNTVLPSESMKVVAESMGIAQIQEETCQLLTDEDALKFMHMGKRQKLTTSDIDYALKLKNVEPLYGFHAQEFIPFRFASGGGRELYFYEEKEVDLSDIINTPLP

SEQ ID NO: 86580 - protein, 141 aa, Homo sapiens
  Payload ID: 17332
  Gene Symbol: TAF6
  Gene Name: TAF6 RNA polymerase II, TATA box binding protein (TBP)-associated factor, 80kDa
  ENSP ID: ENSP00000428639
MAEEKKLKLSNTVLPSESMKVVAESMGIAQIQEETCQLLTDEDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPP

SEQ ID NO: 86581 - protein, 622 aa, Homo sapiens
  Payload ID: 17333
  Gene Symbol: TAF6L
  Gene Name: TAF6-like RNA polymerase II, p300/CBP-associated factor (PCAF)-associated factor, 65kDa
  Uniprot ID: Q9Y6J9
  ENSP ID: ENSP00000294168
MSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSVPSAVSSLTDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRPLCCHYGAVVGLHALGWKAVERVLYPHLSTYWTNLQAVLDDYSVSNAQVKADGHKVYGAILVAVERLLKMKAQAAEPNRGGPGGRGCRRLDDLPWDSLLFQESSSGGGAEPSFGSGLPLPPGGAGPEDPSLSVTLADIYRELYAFFGDSLATRFGTGQPAPTAPRPPGDKKEPAAAPDSVRKMPQLTASAIVSPHGDESPRGSGGGGPASASGPAASESRPLPRVHRARGAPRQQGPGTGTRDVFQKSRFAPRGAPHFRFIIAGRQAGRRCRGRLFQTAFPAPYGPSPASRYVQKLPMIGRTSRPARRWALSDYSLYLPL

SEQ ID NO: 86582 - protein, 145 aa, Homo sapiens
  Payload ID: 17333
  Gene Symbol: TAF6L
  Gene Name: TAF6-like RNA polymerase II, p300/CBP-associated factor (PCAF)-associated factor, 65kDa
  ENSP ID: ENSP00000434662
MSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGS

SEQ ID NO: 86583 - protein, 50 aa, Homo sapiens
  Payload ID: 17333
  Gene Symbol: TAF6L
  Gene Name: TAF6-like RNA polymerase II, p300/CBP-associated factor (PCAF)-associated factor, 65kDa
  ENSP ID: ENSP00000435116
MSEREERRFVEIPRESVRLMAESTGLELSDEVAALLAEDVCYRLREATQN

SEQ ID NO: 86584 - protein, 63 aa, Homo sapiens
  Payload ID: 17333
  Gene Symbol: TAF6L
  Gene Name: TAF6-like RNA polymerase II, p300/CBP-associated factor (PCAF)-associated factor, 65kDa
  ENSP ID: ENSP00000435443
MSEREERRFVEIPRESVRLMAESTGLELSDEVAALLAEDVCYRLREATQLSVHEAHQTPEADG

SEQ ID NO: 86585 - protein, 349 aa, Homo sapiens
  Payload ID: 17334
  Gene Symbol: TAF7
  Gene Name: TAF7 RNA polymerase II, TATA box binding protein (TBP)-associated factor, 55kDa
  Uniprot ID: Q15545
  ENSP ID: ENSP00000312709
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQENEGTNQLVMGIQKQIDNMKGKLQETQDRAKRQEDLIMKVENLALKNRFQAVLDELKQKEDREKEQLSSLQEELESLLEK

SEQ ID NO: 86586 - protein, 48 aa, Homo sapiens
  Payload ID: 17334
  Gene Symbol: TAF7
  Gene Name: TAF7 RNA polymerase II, TATA box binding protein (TBP)-associated factor, 55kDa
  ENSP ID: ENSP00000485510
MSKSKDDAPHELESQFILRLPPEYASTVRRAVQSGHVNLKDRLTIELH

SEQ ID NO: 86587 - protein, 302 aa, Homo sapiens
  Payload ID: 17335
  Gene Symbol: TAF7L
  Gene Name: TAF7-like RNA polymerase II, TATA box binding protein (TBP)-associated factor, 50kDa
  Uniprot ID: Q5H9L4
  ENSP ID: ENSP00000320283
MSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSVMEIQKQIEKKEKKLHKIQNKAQRQKDLIMKVENLTLKNHFQSVLEQLELQEKQKNEKLISLQEQLQRFLKK

SEQ ID NO: 86588 - protein, 376 aa, Homo sapiens
  Payload ID: 17335
  Gene Symbol: TAF7L
  Gene Name: TAF7-like RNA polymerase II, TATA box binding protein (TBP)-associated factor, 50kDa
  Uniprot ID: Q5H9L4
  ENSP ID: ENSP00000349235
MSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSEYDMLREMFSDSRSNNDDDEDEDDEDEDEDEDEDEDEDKEEEEEDCSEEYLERQLQAEFIESGQYRANEGTSSIVMEIQKQIEKKEKKLHKIQNKAQRQKDLIMKVENLTLKNHFQSVLEQLELQEKQKNEKLISLQEQLQRFLKK

SEQ ID NO: 86589 - protein, 462 aa, Homo sapiens
  Payload ID: 17335
  Gene Symbol: TAF7L
  Gene Name: TAF7-like RNA polymerase II, TATA box binding protein (TBP)-associated factor, 50kDa
  Uniprot ID: Q5H9L4
  ENSP ID: ENSP00000361998
MECPEGQLPISSENDSTPTVSTSEVTSQQEPQILVDRGSETTYESSADIAGDEGTQIPADEDTQTDADSSAQAAAQAPENFQEGKDMSESQDEVPDEVENQFILRLPLEHACTVRNLARSQSVKMKDKLKIDLLPDGRHAVVEVEDVPLAAKLVDLPCVIESLRTLDKKTFYKTADISQMLVCTADGDIHLSPEEPAASTDPNIVRKKERGREEKCVWKHGITPPLKNVRKKRFRKTQKKVPDVKEMEKSSFTEYIESPDVENEVKRLLRSDAEAVSTRWEVIAEDGTKEIESQGSIPGFLISSGMSSHKQGHTSSEYDMLREMFSDSRSNNDDDEDEDDEDEDEDEDEDEDEDKEEEEEDCSEEYLERQLQAEFIESGQYRANEGTSSIVMEIQKQIEKKEKKLHKIQNKAQRQKDLIMKVENLTLKNHFQSVLEQLELQEKQKNEKLISLQEQLQRFLKK

SEQ ID NO: 86590 - protein, 310 aa, Homo sapiens
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENSP ID: ENSP00000362068
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMEDSGAEKENTSVLQQNPSLSGSRNGEENIIDNPYLRPVKKPKIRRKKSLS

SEQ ID NO: 86591 - protein, 174 aa, Homo sapiens
  Payload ID: 17336
  Gene Symbol: TAF8
  Gene Name: TAF8 RNA polymerase II, TATA box binding protein (TBP)-associated factor, 43kDa
  ENSP ID: ENSP00000362069
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPVSDEALGLRVV

SEQ ID NO: 86592 - protein, 338 aa, Homo sapiens
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENSP ID: ENSP00000362073
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMIESRSVTQAGVQWQDLGSLQPPPPGFKRFSSLSLLSSWNYRRILEPRRRTPLSCSRTPPCRVAGMGRRTSSITLICGR

SEQ ID NO: 86593 - protein, 311 aa, Homo sapiens
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENSP ID: ENSP00000411900
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMEDSGAEKENTSVLQQNPSLSGSRNGEENIIDNPYLRPVKKPKIRRKKPDTF

SEQ ID NO: 86594 - protein, 60 aa, Homo sapiens
  Payload ID: 17336
  Gene Symbol: TAF8
  Gene Name: TAF8 RNA polymerase II, TATA box binding protein (TBP)-associated factor, 43kDa
  ENSP ID: ENSP00000417738
MLQSYISEIGRSAKSYCEHTARTQPTLSDIVVTLVEMGFNVDTLPAYAKRSQRMVITARK

SEQ ID NO: 86595 - protein, 123 aa, Homo sapiens
  Payload ID: 17336
  Gene Symbol: TAF8
  Gene Name: TAF8 RNA polymerase II, TATA box binding protein (TBP)-associated factor, 43kDa
  ENSP ID: ENSP00000417760
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITARK

SEQ ID NO: 86596 - protein, 338 aa, Homo sapiens; identical to SEQ ID NO: 86592
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENSP ID: ENSP00000417867

SEQ ID NO: 86597 - protein, 234 aa, Homo sapiens
  Payload ID: 17336
  Gene Symbol: TAF8
  Gene Name: TAF8 RNA polymerase II, TATA box binding protein (TBP)-associated factor, 43kDa
  ENSP ID: ENSP00000418029
MLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPSLLPSELEMQQMEETDSSEQDEQTDTENLALHISMEDSGAEKENTSVLQQNPSLSGSRNGEENIIDNPYLRPVKKPKIRRKKSLS

SEQ ID NO: 86598 - protein, 264 aa, Homo sapiens; identical to SEQ ID NO: 2876
  Payload ID: 17337
  Gene Symbol: TAF9
  Gene Name: TAF9 RNA polymerase II, TATA box binding protein (TBP)-associated factor, 32kDa
  Uniprot ID: Q16594
  ENSP ID: ENSP00000217893

SEQ ID NO: 86599 - protein, 264 aa, Homo sapiens; identical to SEQ ID NO: 2876
  Payload ID: 17337
  Gene Symbol: TAF9
  Gene Name: TAF9 RNA polymerase II, TATA box binding protein (TBP)-associated factor, 32kDa
  Uniprot ID: Q16594
  ENSP ID: ENSP00000370193

SEQ ID NO: 86600 - protein, 264 aa, Homo sapiens; identical to SEQ ID NO: 2876
  Payload ID: 17337
  Gene Symbol: TAF9
  Gene Name: TAF9 RNA polymerase II, TATA box binding protein (TBP)-associated factor, 32kDa
  Uniprot ID: Q16594
  ENSP ID: ENSP00000421873

SEQ ID NO: 86601 - protein, 127 aa, Homo sapiens; identical to SEQ ID NO: 2881
  Payload ID: 17337
  Gene Symbol: TAF9
  Gene Name: TAF9 RNA polymerase II, TATA box binding protein (TBP)-associated factor, 32kDa
  ENSP ID: ENSP00000425798

SEQ ID NO: 86602 - protein, 197 aa, Homo sapiens; identical to SEQ ID NO: 2882
  Payload ID: 17337
  Gene Symbol: TAF9
  Gene Name: TAF9 RNA polymerase II, TATA box binding protein (TBP)-associated factor, 32kDa
  ENSP ID: ENSP00000425944

SEQ ID NO: 86603 - protein, 135 aa, Homo sapiens; identical to SEQ ID NO: 2884
  Payload ID: 17337
  Gene Symbol: TAF9
  Gene Name: TAF9 RNA polymerase II, TATA box binding protein (TBP)-associated factor, 32kDa
  ENSP ID: ENSP00000426283

SEQ ID NO: 86604 - protein, 166 aa, Homo sapiens; identical to SEQ ID NO: 2885
  Payload ID: 17337
  Gene Symbol: TAF9
  Gene Name: TAF9 RNA polymerase II, TATA box binding protein (TBP)-associated factor, 32kDa
  ENSP ID: ENSP00000427343

SEQ ID NO: 86605 - protein, 102 aa, Homo sapiens; identical to SEQ ID NO: 2878
  Payload ID: 17337
  Gene Symbol: TAF9
  Gene Name: TAF9 RNA polymerase II, TATA box binding protein (TBP)-associated factor, 32kDa
  ENSP ID: ENSP00000427617

SEQ ID NO: 86606 - protein, 169 aa, Homo sapiens; identical to SEQ ID NO: 2873
  Payload ID: 17337
  Gene Symbol: TAF9
  Gene Name: TAF9 RNA polymerase II, TATA box binding protein (TBP)-associated factor, 32kDa
  ENSP ID: ENSP00000480829

SEQ ID NO: 86607 - protein, 141 aa, Homo sapiens; identical to SEQ ID NO: 2875
  Payload ID: 17337
  Gene Symbol: TAF9
  Gene Name: TAF9 RNA polymerase II, TATA box binding protein (TBP)-associated factor, 32kDa
  ENSP ID: ENSP00000483874

SEQ ID NO: 86608 - protein, 172 aa, Homo sapiens; identical to SEQ ID NO: 2874
  Payload ID: 17337
  Gene Symbol: TAF9
  Gene Name: TAF9 RNA polymerase II, TATA box binding protein (TBP)-associated factor, 32kDa
  ENSP ID: ENSP00000484679

SEQ ID NO: 86609 - protein, 47 aa, Homo sapiens; identical to SEQ ID NO: 2883
  Payload ID: 17337
  Gene Symbol: TAF9
  Gene Name: TAF9 RNA polymerase II, TATA box binding protein (TBP)-associated factor, 32kDa
  ENSP ID: ENSP00000485291

SEQ ID NO: 86610 - protein, 109 aa, Homo sapiens; identical to SEQ ID NO: 2880
  Payload ID: 17337
  Gene Symbol: TAF9
  Gene Name: TAF9 RNA polymerase II, TATA box binding protein (TBP)-associated factor, 32kDa
  ENSP ID: ENSP00000485297

SEQ ID NO: 86611 - protein, 251 aa, Homo sapiens
  Payload ID: 17338
  Gene Symbol: TAF9B
  Gene Name: TAF9B RNA polymerase II, TATA box binding protein (TBP)-associated factor, 31kDa
  Uniprot ID: Q9HBM6
  ENSP ID: ENSP00000339917
MESGKMAPPKNAPRDALVMAQILKDMGITEYEPRVINQMLEFAFRYVTTILDDAKIYSSHAKKPNVDADDVRLAIQCRADQSFTSPPPRDFLLDIARQKNQTPLPLIKPYAGPRLPPDRYCLTAPNYRLKSLIKKGPNQGRLVPRLSVGAVSSKPTTPTIATPQTVSVPNKVATPMSVTSQRFTVQIPPSQSTPVKPVPATTAVQNVLINPSMIGPKNILITTNMVSSQNTANEANPLKRKHEDDDDNDIM

SEQ ID NO: 86612 - protein, 262 aa, Homo sapiens
  Payload ID: 17339
  Gene Symbol: TAZ
  Gene Name: tafazzin
  ENSP ID: ENSP00000358791
MPLHVKWPFPAVPPLTWTLASSVVMGLVGTYSCFWTSEWAQAEAGPPGYPCPAGGILKLRHIWNLKLMRWTPAAADICFTKELHSHFFSLGKCVPVCRGDGVYQKGMDFILEKLNHGDWVHIFPEGIGRLIAECHLNPIILPLWHVGEPGDGDREMASGVGGLGLPLVPGCPAPPHVWPSVHCAAGMNDVLPNSPPYFPRFGQKITVLIGKPFSALPVLERLRAENKSAVEMRKALTDFIQEEFQHLKTQAEQLHNHLQPGR

SEQ ID NO: 86613 - protein, 184 aa, Homo sapiens
  Payload ID: 17339
  Gene Symbol: TAZ
  Gene Name: tafazzin
  ENSP ID: ENSP00000398193
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRDGVYQKGMDFILEKLNHGDWVHIFPEGKVNMSSEFLRFKWGIGRLIAECHLNPIILPLWHV

SEQ ID NO: 86614 - protein, 34 aa, Homo sapiens
  Payload ID: 17339
  Gene Symbol: TAZ
  Gene Name: tafazzin
  ENSP ID: ENSP00000406257
  MOD_RES (1)..(1): Any amino acid
XLITVSNHQSCMDDPHLWGILKLRHIWNLKLMRW

SEQ ID NO: 86615 - protein, 278 aa, Homo sapiens
  Payload ID: 17339
  Gene Symbol: TAZ
  Gene Name: tafazzin
  Uniprot ID: Q16635
  ENSP ID: ENSP00000419854
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGDGVYQKGMDFILEKLNHGDWVHIFPEGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 86616 - protein, 292 aa, Homo sapiens
  Payload ID: 17339
  Gene Symbol: TAZ
  Gene Name: tafazzin
  Uniprot ID: Q16635
  ENSP ID: ENSP00000469981
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGDGVYQKGMDFILEKLNHGDWVHIFPEGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 86617 - protein, 248 aa, Homo sapiens
  Payload ID: 17339
  Gene Symbol: TAZ
  Gene Name: tafazzin
  Uniprot ID: Q16635
  ENSP ID: ENSP00000478154
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGDGVYQKGMDFILEKLNHGDWVHIFPEGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 86618 - protein, 95 aa, Homo sapiens
  Payload ID: 17339
  Gene Symbol: TAZ
  Gene Name: tafazzin
  ENSP ID: ENSP00000479311
MPLHVKWPFPAVPPLTWTLASSVVMGLVGTYSCFWTKYMNHLTVHNREVLYELIEKRGPATPLITVSNHQSCMDDPHLWGILKLRHIWNLKLMRW

SEQ ID NO: 86619 - protein, 95 aa, Homo sapiens; identical to SEQ ID NO: 86618
  Payload ID: 17339
  Gene Symbol: TAZ
  Gene Name: tafazzin
  ENSP ID: ENSP00000480133

SEQ ID NO: 86620 - protein, 262 aa, Homo sapiens
  Payload ID: 17339
  Gene Symbol: TAZ
  Gene Name: tafazzin
  Uniprot ID: Q16635
  ENSP ID: ENSP00000481037
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGDGVYQKGMDFILEKLNHGDWVHIFPEGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 86621 - protein, 95 aa, Homo sapiens; identical to SEQ ID NO: 86618
  Payload ID: 17339
  Gene Symbol: TAZ
  Gene Name: tafazzin
  ENSP ID: ENSP00000481645

SEQ ID NO: 86622 - protein, 196 aa, Homo sapiens
  Payload ID: 17339
  Gene Symbol: TAZ
  Gene Name: tafazzin
  ENSP ID: ENSP00000482070
MPLHVKWPFPAVPPLTWTLASSVVMGLVGTYSCFWTSEWAQAEAGPPGYPCPAGEYMNHLTVHNREVLYELIEKRGPATPLITVSNHQSCMDDPHLWGILKLRHIWNLKLMRWTPAAADICFTKELHSHFFSLGKCVPVCRGDGVYQKGMDFILEKLNHGDWVHIFPEGKVNMSSEFLRFKWGIGRLIAECHLNPI

SEQ ID NO: 86623 - protein, 170 aa, Homo sapiens
  Payload ID: 17339
  Gene Symbol: TAZ
  Gene Name: tafazzin
  ENSP ID: ENSP00000483636
MPLHVKWPFPAVPPLTWTLASSVVMGLVGTYSCFWTSEWAQAEAGPPGYPCPAGEYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRRE

SEQ ID NO: 86624 - protein, 2541 aa, Homo sapiens
  Payload ID: 17340
  Gene Symbol: TLN1
  Gene Name: talin 1
  Uniprot ID: Q9Y490
  ENSP ID: ENSP00000316029
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVRQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPREGISQEALHTQMLTAVQEISHLIEPLANAARAEASQLGHKVSQMAQYFEPLTLAAVGAASKTLSHPQQMALLDQTKTLAESALQLLYTAKEAGGNPKQAAHTQEALEEAVQMMTEAVEDLTTTLNEAASAAGVVGGMVDSITQAINQLDEGPMGEPEGSFVDYQTTMVRTAKAIAVTVQEMVTKSNTSPEELGPLANQLTSDYGRLASEAKPAAVAAENEEIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAVFCSPEPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 86625 - protein, 2542 aa, Homo sapiens
  Payload ID: 17341
  Gene Symbol: TLN2
  Gene Name: talin 2
  Uniprot ID: Q9Y4G6
  ENSP ID: ENSP00000303476
MVALSLKICVRHCNVVKTMQFEPSTAVYDACRVIRERVPEAQTGQASDYGLFLSDEDPRKGIWLEAGRTLDYYMLRNGDILEYKKKQRPQKIRMLDGSVKTVMVDDSKTVGELLVTICSRIGITNYEEYSLIQETIEEKKEEGTGTLKKDRTLLRDERKMEKLKAKLHTDDDLNWLDHSRTFREQGVDENETLLLRRKFFYSDQNVDSRDPVQLNLLYVQARDDILNGSHPVSFEKACEFGGFQAQIQFGPHVEHKHKPGFLDLKEFLPKEYIKQRGAEKRIFQEHKNCGEMSEIEAKVKYVKLARSLRTYGVSFFLVKEKMKGKNKLVPRLLGITKDSVMRVDEKTKEVLQEWPLTTVKRWAASPKSFTLDFGEYQESYYSVQTTEGEQISQLIAGYIDIILKKKQSKDRFGLEGDEESTMLEESVSPKKSTILQQQFNRTGKAEHGSVALPAVMRSGSSGPETFNVGSMPSPQQQVMVGQMHRGHMPPLTSAQQALMGTINTSMHAVQQAQDDLSELDSLPPLGQDMASRVWVQNKVDESKHEIHSQVDAITAGTASVVNLTAGDPADTDYTAVGCAITTISSNLTEMSKGVKLLAALMDDEVGSGEDLLRAARTLAGAVSDLLKAVQPTSGEPRQTVLTAAGSIGQASGDLLRQIGENETDERFQDVLMSLAKAVANAAAMLVLKAKNVAQVAEDTVLQNRVIAAATQCALSTSQLVACAKVVSPTISSPVCQEQLIEAGKLVDRSVENCVRACQAATTDSELLKQVSAAASVVSQALHDLLQHVRQFASRGEPIGRYDQATDTIMCVTESIFSSMGDAGEMVRQARVLAQATSDLVNAMRSDAEAEIDMENSKKLLAAAKLLADSTARMVEAAKGAAANPENEDQQQRLREAAEGLRVATNAAAQNAIKKKIVNRLEVAAKQAAAAATQTIAASQNAAVSNKNPAAQQQLVQSCKAVADHIPQLVQGVRGSQAQAEDLSAQLALIISSQNFLQPGSKMVSSAKAAVPTVSDQAAAMQLSQCAKNLATSLAELRTASQKAHEACGPMEIDSALNTVQTLKNELQDAKMAAVESQLKPLPGETLEKCAQDLGSTSKAVGSSMAQLLTCAAQGNEHYTGVAARETAQALKTLAQAARGVAASTTDPAAAHAMLDSARDVMEGSAMLIQEAKQALIAPGDAERQQRLAQVAKAVSHSLNNCVNCLPGQKDVDVALKSIGESSKKLLVDSLPPSTKPFQEAQSELNQAAADLNQSAGEVVHATRGQSGELAAASGKFSDDFDEFLDAGIEMAGQAQTKEDQIQVIGNLKNISMASSKLLLAAKSLSVDPGAPNAKNLLAAAARAVTESINQLITLCTQQAPGQKECDNALRELETVKGMLDNPNEPVSDLSYFDCIESVMENSKVLGESMAGISQNAKTGDLPAFGECVGIASKALCGLTEAAAQAAYLVGISDPNSQAGHQGLVDPIQFARANQAIQMACQNLVDPGSSPSQVLSAATIVAKHTSALCNACRIASSKTANPVAKRHFVQSAKEVANSTANLVKTIKALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 86626 - protein, 2542 aa, Homo sapiens; identical to SEQ ID NO: 86625
  Payload ID: 17341
  Gene Symbol: TLN2
  Gene Name: talin 2
  Uniprot ID: Q9Y4G6
  ENSP ID: ENSP00000453508

SEQ ID NO: 86627 - protein, 1471 aa, Homo sapiens
  Payload ID: 17341
  Gene Symbol: TLN2
  Gene Name: talin 2
  ENSP ID: ENSP00000453730
EKCAQDLGSTSKAVGSSMAQLLTCAAQGNEHYTGVAARETAQALKTLAQAARGVAASTTDPAAAHAMLDSARDVMEGSAMLIQEAKQALIAPGDAERQQRLAQVAKAVSHSLNNCVNCLPGQKDVDVALKSIGESSKKLLVDSLPPSTKPFQEAQSELNQAAADLNQSAGEVVHATRGQSGELAAASGKFSDDFDEFLDAGIEMAGQAQTKEDQIQVIGNLKNISMASSKLLLAAKSLSVDPGAPNAKNLLAAAARAVTESINQLITLCTQQAPGQKECDNALRELETVKGMLDNPNEPVSDLSYFDCIESVMENSKVLGESMAGISQNAKTGDLPAFGECVGIASKALCGLTEAAAQAAYLVGISDPNSQAGHQGLVDPIQFARANQAIQMACQNLVDPGSSPSQVLSAATIVAKHTSALCNACRIASSKTANPVAKRHFVQSAKEVANSTANLVKTIKALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQVMVTDAGGKILLLERAAGNAVKRASDNLVRAAQKAAFGKADDDDVVVKTKFVGGIAQIIAAQEEMLKKERELEEARKKLAQIRQQQYKFLPTELREDEG

SEQ ID NO: 86628 - protein, 330 aa, Homo sapiens
  Payload ID: 17341
  Gene Symbol: TLN2
  Gene Name: talin 2
  ENSP ID: ENSP00000453812
MLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEVCHLKTPILRCTHTLVPTPGYFFIA

SEQ ID NO: 86629 - protein, 316 aa, Homo sapiens
  Payload ID: 17342
  Gene Symbol: TAMM41
  Gene Name: TAM41 mitochondrial translocator assembly and maintenance homolog
  Uniprot ID: Q96BW9
  ENSP ID: ENSP00000273037
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLKKSVIYSSLKLHKMWKGWLRKTS

SEQ ID NO: 86630 - protein, 452 aa, Homo sapiens
  Payload ID: 17342
  Gene Symbol: TAMM41
  Gene Name: TAM41 mitochondrial translocator assembly and maintenance homolog
  Uniprot ID: Q96BW9
  ENSP ID: ENSP00000388598
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLSAIVRPSSIRQSTKGIFTAGKSFGNPCVTYLLTEWLPHSWLQCKALYLLGACEMLSFDGHKLGYCSKVQTGITAAEPGGRTMSDHWQCCWKLYCPSEFSETLPVCRVFPSYCFIYQSYRCIGLQKQQHLCSPSSSPSLRQLLPSVLVGYFCCYCHFSKW

SEQ ID NO: 86631 - protein, 107 aa, Homo sapiens; identical to SEQ ID NO: 1120
  Payload ID: 17342
  Gene Symbol: TAMM41
  Gene Name: TAM41 mitochondrial translocator assembly and maintenance homolog
  ENSP ID: ENSP00000390910

SEQ ID NO: 86632 - protein, 151 aa, Homo sapiens
  Payload ID: 17342
  Gene Symbol: TAMM41
  Gene Name: TAM41 mitochondrial translocator assembly and maintenance homolog
  ENSP ID: ENSP00000392289
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPASLAVSQEFTGFSL

SEQ ID NO: 86633 - protein, 337 aa, Homo sapiens
  Payload ID: 17342
  Gene Symbol: TAMM41
  Gene Name: TAM41 mitochondrial translocator assembly and maintenance homolog
  Uniprot ID: Q96BW9
  ENSP ID: ENSP00000398596
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLSAIVRPSSIRQSTKGIFTAGLKKSVIYSSLKLHKMWKGWLRKTS

SEQ ID NO: 86634 - protein, 55 aa, Homo sapiens
  Payload ID: 17342
  Gene Symbol: TAMM41
  Gene Name: TAM41 mitochondrial translocator assembly and maintenance homolog
  ENSP ID: ENSP00000399218
  MOD_RES (1)..(1): Any amino acid
XDFRMVVGEDKTKVLNIVKPNIAHFRELYGSILQENPQVVYKSQQGWLEVTVCGK

SEQ ID NO: 86635 - protein, 151 aa, Homo sapiens; identical to SEQ ID NO: 86632
  Payload ID: 17342
  Gene Symbol: TAMM41
  Gene Name: TAM41 mitochondrial translocator assembly and maintenance homolog
  ENSP ID: ENSP00000406054

SEQ ID NO: 86636 - protein, 151 aa, Homo sapiens; identical to SEQ ID NO: 86632
  Payload ID: 17342
  Gene Symbol: TAMM41
  Gene Name: TAM41 mitochondrial translocator assembly and maintenance homolog
  ENSP ID: ENSP00000485057

SEQ ID NO: 86637 - protein, 151 aa, Homo sapiens; identical to SEQ ID NO: 86632
  Payload ID: 17342
  Gene Symbol: TAMM41
  Gene Name: TAM41 mitochondrial translocator assembly and maintenance homolog
  ENSP ID: ENSP00000485060

SEQ ID NO: 86638 - protein, 107 aa, Homo sapiens; identical to SEQ ID NO: 1120
  Payload ID: 17342
  Gene Symbol: TAMM41
  Gene Name: TAM41 mitochondrial translocator assembly and maintenance homolog
  ENSP ID: ENSP00000485177

SEQ ID NO: 86639 - protein, 55 aa, Homo sapiens; identical to SEQ ID NO: 86634
  Payload ID: 17342
  Gene Symbol: TAMM41
  Gene Name: TAM41 mitochondrial translocator assembly and maintenance homolog
  ENSP ID: ENSP00000485204
  MOD_RES (1)..(1): Any amino acid

SEQ ID NO: 86640 - protein, 236 aa, Homo sapiens
  Payload ID: 17342
  Gene Symbol: TAMM41
  Gene Name: TAM41 mitochondrial translocator assembly and maintenance homolog
  ENSP ID: ENSP00000485433
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLE

SEQ ID NO: 86641 - protein, 236 aa, Homo sapiens; identical to SEQ ID NO: 86640
  Payload ID: 17342
  Gene Symbol: TAMM41
  Gene Name: TAM41 mitochondrial translocator assembly and maintenance homolog
  ENSP ID: ENSP00000485550

SEQ ID NO: 86642 - protein, 236 aa, Homo sapiens; identical to SEQ ID NO: 86640
  Payload ID: 17342
  Gene Symbol: TAMM41
  Gene Name: TAM41 mitochondrial translocator assembly and maintenance homolog
  ENSP ID: ENSP00000485654

SEQ ID NO: 86643 - protein, 107 aa, Homo sapiens; identical to SEQ ID NO: 1120
  Payload ID: 17342
  Gene Symbol: TAMM41
  Gene Name: TAM41 mitochondrial translocator assembly and maintenance homolog
  ENSP ID: ENSP00000486481

SEQ ID NO: 86644 - protein, 490 aa, Homo sapiens
  Payload ID: 17343
  Gene Symbol: TC2N
  Gene Name: tandem C2 domains, nuclear
  Uniprot ID: Q8N9U0
  ENSP ID: ENSP00000343199
MATEFIKSCCGGCFYGETEKHNFSVERDFKAAVPNSQNATISVPPLTSVSVKPQLGCTEDYLLSKLPSDGKEVPFVVPKFKLSYIQPRTQETPSHLEELEGSARASFGDRKVELSSSSQHGPSYDVYNPFYMYQHISPDLSRRFPPRSEVKRLYGSVCDLRTNKLPGSPGLSKSMFDLTNSSQRFIQRHDSLSSVPSSSSSRKNSQGSNRSLDTITLSGDERDFGRLNVKLFYNSSVEQIWITVLQCRDLSWPSSYGDTPTVSIKGILTLPKPVHFKSSAKEGSNAIEFMETFVFAIKLQNLQTVRLVFKIQTQTPRKKTIGECSMSLRTLSTQEMDYSLDITPPSKISVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 86645 - protein, 490 aa, Homo sapiens; identical to SEQ ID NO: 86644
  Payload ID: 17343
  Gene Symbol: TC2N
  Gene Name: tandem C2 domains, nuclear
  Uniprot ID: Q8N9U0
  ENSP ID: ENSP00000353802

SEQ ID NO: 86646 - protein, 490 aa, Homo sapiens; identical to SEQ ID NO: 86644
  Payload ID: 17343
  Gene Symbol: TC2N
  Gene Name: tandem C2 domains, nuclear
  Uniprot ID: Q8N9U0
  ENSP ID: ENSP00000387882

SEQ ID NO: 86647 - protein, 242 aa, Homo sapiens
  Payload ID: 17343
  Gene Symbol: TC2N
  Gene Name: tandem C2 domains, nuclear
  ENSP ID: ENSP00000450922
RSLDTITLSGDERDFGRLNVKLFYNSSVEQIWITVLQAIEFMETFVFAIKLQNLQTVRLVFKIQTQTPRKKTIGECSMSLRTLSTQEMDYSLDITPPSKISVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 86648 - protein, 426 aa, Homo sapiens
  Payload ID: 17343
  Gene Symbol: TC2N
  Gene Name: tandem C2 domains, nuclear
  Uniprot ID: Q8N9U0
  ENSP ID: ENSP00000451317
MATEFIKSCCGGCFYGETEKHNFSVERDFKAAVPNSQNATISVPPLTSVSVKPQLGCTEDYLLSKLPSDGKEVPFVVPKFKLSYIQPRTQETPSHLEELEGSARASFGDRKVELSSSSQHGPSYDVYNPFYMYQHISPDLSRRFPPRSEVKRLYGSVCDLRTNKLPGSPGLSKSMFDLTNSSQRFIQRHDSLSSVPSSSSSRKNSQGSNRSLDTITLSGDERDFGRLNVKLFYNSSVEQIWITVLQCRDLSWPSSYGDTPTVSIKGILTLPKPVHFKSSAKEGSNVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 86649 - protein, 490 aa, Homo sapiens; identical to SEQ ID NO: 86644
  Payload ID: 17343
  Gene Symbol: TC2N
  Gene Name: tandem C2 domains, nuclear
  Uniprot ID: Q8N9U0
  ENSP ID: ENSP00000478127

SEQ ID NO: 86650 - protein, 490 aa, Homo sapiens; identical to SEQ ID NO: 86644
  Payload ID: 17343
  Gene Symbol: TC2N
  Gene Name: tandem C2 domains, nuclear
  Uniprot ID: Q8N9U0
  ENSP ID: ENSP00000483305

SEQ ID NO: 86651 - protein, 490 aa, Homo sapiens; identical to SEQ ID NO: 86644
  Payload ID: 17343
  Gene Symbol: TC2N
  Gene Name: tandem C2 domains, nuclear
  Uniprot ID: Q8N9U0
  ENSP ID: ENSP00000487608

SEQ ID NO: 86652 - protein, 242 aa, Homo sapiens; identical to SEQ ID NO: 86647
  Payload ID: 17343
  Gene Symbol: TC2N
  Gene Name: tandem C2 domains, nuclear
  ENSP ID: ENSP00000488045

SEQ ID NO: 86653 - protein, 426 aa, Homo sapiens; identical to SEQ ID NO: 86648
  Payload ID: 17343
  Gene Symbol: TC2N
  Gene Name: tandem C2 domains, nuclear
  Uniprot ID: Q8N9U0
  ENSP ID: ENSP00000488431

SEQ ID NO: 86654 - protein, 729 aa, Homo sapiens
  Payload ID: 17344
  Gene Symbol: TBK1
  Gene Name: TANK-binding kinase 1
  Uniprot ID: Q9UHD2
  ENSP ID: ENSP00000329967
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 86655 - protein, 48 aa, Homo sapiens
  Payload ID: 17344
  Gene Symbol: TBK1
  Gene Name: TANK-binding kinase 1
  ENSP ID: ENSP00000444428
MREFEVLKKLNHKNIVKLFAIEEETTTRHKVLIMEFCPCGSLYTVLEE

SEQ ID NO: 86656 - protein, 98 aa, Homo sapiens
  Payload ID: 17344
  Gene Symbol: TBK1
  Gene Name: TANK-binding kinase 1
  ENSP ID: ENSP00000445628
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVL

SEQ ID NO: 86657 - protein, 103 aa, Homo sapiens
  Payload ID: 17344
  Gene Symbol: TBK1
  Gene Name: TANK-binding kinase 1
  ENSP ID: ENSP00000445834
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSN

SEQ ID NO: 86658 - protein, 1729 aa, Homo sapiens
  Payload ID: 17345
  Gene Symbol: TNKS1BP1
  Gene Name: tankyrase 1 binding protein 1, 182kDa
  Uniprot ID: Q9C0C2
  ENSP ID: ENSP00000350990
MKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVRKAPAPFRPASERFAATTVEEILAKMEQPRKEVLASPDRLWGSRLTFNHDGSSRYGPRTYGTTTAPRDEDGSTLFRGWSQEGPVKSPAECREEHSKTPEERSLPSDLAFNGDLAKAASSELPADISKPWIPSSPAPSSENGGPASPGLPAEASGSGPGSPHLHPPDKSSPCHSQLLEAQTPEASQASPCPAVTPSAPSAALPDEGSRHTPSPGLPAEGAPEAPRPSSPPPEVLEPHSLDQPPATSPRPLIEVGELLDLTRTFPSGGEEEAKGDAHLRPTSLVQRRFSEGVLQSPSQDQEKLGGSLAALPQGQGSQLALDRPFGAESNWSLSQSFEWTFPTRPSGLGVWRLDSPPPSPITEASEAAEAAEAGNLAVSSREEGVSQQGQGAGSAPSGSGSSWVQGDDPSMSLTQKGDGESQPQFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPSGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMYRSRANLGRKRGHRAPVIRPGGTLGLSEAADSDAHLFQDSTEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 86659 - protein, 243 aa, Homo sapiens
  Payload ID: 17345
  Gene Symbol: TNKS1BP1
  Gene Name: tankyrase 1 binding protein 1, 182kDa
  ENSP ID: ENSP00000431616
MKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVRKAPAPFRPASERFAATTVEEILAKMEQPRKEVLASPDRLWGSRLTFNHDGSSRYGPRTYGTTTAPRDEDGSTLFRGWSQEGPVKSPAECREEHSKTPEER

SEQ ID NO: 86660 - protein, 143 aa, Homo sapiens
  Payload ID: 17345
  Gene Symbol: TNKS1BP1
  Gene Name: tankyrase 1 binding protein 1, 182kDa
  ENSP ID: ENSP00000433576
MKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVR

SEQ ID NO: 86661 - protein, 1729 aa, Homo sapiens; identical to SEQ ID NO: 86658
  Payload ID: 17345
  Gene Symbol: TNKS1BP1
  Gene Name: tankyrase 1 binding protein 1, 182kDa
  Uniprot ID: Q9C0C2
  ENSP ID: ENSP00000437271

SEQ ID NO: 86662 - protein, 1327 aa, Homo sapiens
  Payload ID: 17346
  Gene Symbol: TNKS
  Gene Name: tankyrase, TRF1-interacting ankyrin-related ADP-ribose polymerase
  Uniprot ID: O95271
  ENSP ID: ENSP00000311579
MAASRRSQHHHHHHQQQLQPAPGASAPPPPPPPPLSPGLAPGTTPASPTASGLAPFASPRHGLALPEGDGSRDPPDRPRSPDPVDGTSCCSTTSTICTVAAAPVVPAVSTSSAAGVAPNPAGSGSNNSPSSSSSPTSSSSSSPSSPGSSLAESPEAAGVSSTAPLGPGAAGPGTGVPAVSGALRELLEACRNGDVSRVKRLVDAANVNAKDMAGRKSSPLHFAAGFGRKDVVEHLLQMGANVHARDDGGLIPLHNACSFGHAEVVSLLLCQGADPNARDNWNYTPLHEAAIKGKIDVCIVLLQHGADPNIRNTDGKSALDLADPSAKAVLTGEYKKDELLEAARSGNEEKLMALLTPLNVNCHASDGRKSTPLHLAAGYNRVRIVQLLLQHGADVHAKDKGGLVPLHNACSYGHYEVTELLLKHGACVNAMDLWQFTPLHEAASKNRVEVCSLLLSHGADPTLVNCHGKSAVDMAPTPELRERLTYEFKGHSLLQAAREADLAKVKKTLALEIINFKQPQSHETALHCAVASLHPKRKQVTELLLRKGANVNEKNKDFMTPLHVAAERAHNDVMEVLHKHGAKMNALDTLGQTALHRAALAGHLQTCRLLLSYGSDPSIISLQGFTAAQMGNEAVQQILSESTPIRTSDVDYRLLEASKAGDLETVKQLCSSQNVNCRDLEGRHSTPLHFAAGYNRVSVVEYLLHHGADVHAKDKGGLVPLHNACSYGHYEVAELLVRHGASVNVADLWKFTPLHEAAAKGKYEICKLLLKHGADPTKKNRDGNTPLDLVKEGDTDIQDLLRGDAALLDAAKKGCLARVQKLCTPENINCRDTQGRNSTPLHLAAGYNNLEVAEYLLEHGADVNAQDKGGLIPLHNAASYGHVDIAALLIKYNTCVNATDKWAFTPLHEAAQKGRTQLCALLLAHGADPTMKNQEGQTPLDLATADDIRALLIDAMPPEALPTCFKPQATVVSASLISPASTPSCLSAASSIDNLTGPLAELAVGGASNAGDGAAGTERKEGEVAGLDMNISQFLKSLGLEHLRDIFETEQITLDVLADMGHEELKEIGINAYGHRHKLIKGVERLLGGQQGTNPYLTFHCVNQGTILLDLAPEDKEYQSVEEEMQSTIREHRDGGNAGGIFNRYNVIRIQKVVNKKLRERFCHRQKEVSEENHNHHNERMLFHGSPFINAIIHKGFDERHAYIGGMFGAGIYFAENSSKSNQYVYGIGGGTGCPTHKDRSCYICHRQMLFCRVTLGKSFLQFSTMKMAHAPPGHHSVIGRPSVNGLAYAEYVIYRGEQAYPEYLITYQIMKPEAPSQTATAAEQKT

SEQ ID NO: 86663 - protein, 61 aa, Homo sapiens
  Payload ID: 17346
  Gene Symbol: TNKS
  Gene Name: tankyrase, TRF1-interacting ankyrin-related ADP-ribose polymerase
  ENSP ID: ENSP00000428185
LGKSFLQFSTMKMAHAPPGHHSVIGRPSVNGLAYAEYVIYRGEQVDTLKARHLCSIPAKNT

SEQ ID NO: 86664 - protein, 617 aa, Homo sapiens
  Payload ID: 17346
  Gene Symbol: TNKS
  Gene Name: tankyrase, TRF1-interacting ankyrin-related ADP-ribose polymerase
  ENSP ID: ENSP00000428299
MAASRRSQHHHHHHQQQLQPAPGASAPPPPPPPPLSPGLAPGTTPASPTASGLAPFASPRHGLALPEGDGSRDPPDRPRSPDPVDGTSCCSTTSTICTVAAAPVVPAVSTSSAAGVAPNPAGSGSNNSPSSSSSPTSSSSSSPSSPGSSLAESPEAAGVSSTAPLGPGAAGPGTGVPAVSGALRELLEACRNGDVSRVKRLVDAANVNAKDMAGRKSSPLHFAAGFGRKDVVEHLLQMGANVHARDDGGLIPLHNACSFGHAEVVSLLLCQGADPNARDNWNYTPLHEAAIKGKIDVCIVLLQHGADPNIRNTDGKSALDLADPSAKAVLTGEYKKDELLEAARSGNEEKLMALLTPLNVNCHASDGRKSTPLHLAAGYNRVRIVQLLLQHGADVHAKDKGGLVPLHNACSYGHYEVTELLLKHGACVNAMDLWQFTPLHEAASKNRVEVCSLLLSHGADPTLVNCHGKSAVDMAPTPELRERLTYEFKGHSLLQAAREADLAKVKKTLALEIINFKQPQSHETALHCAVASLHPKRKQVTELLLRKGANVNEKNKDFMTPLHVAAERAHNDVMEVLHKHGAKVRHTPEQSARLSTEQPAALNTASLSPIFLKKLIL

SEQ ID NO: 86665 - protein, 1090 aa, Homo sapiens
  Payload ID: 17346
  Gene Symbol: TNKS
  Gene Name: tankyrase, TRF1-interacting ankyrin-related ADP-ribose polymerase
  ENSP ID: ENSP00000429890
MGANVHARDDGGLIPLHNACSFGHAEVVSLLLCQGADPNARDNWNYTPLHEAAIKGKIDVCIVLLQHGADPNIRNTDGKSALDLADPSAKAVLTGEYKKDELLEAARSGNEEKLMALLTPLNVNCHASDGRKSTPLHLAAGYNRVRIVQLLLQHGADVHAKDKGGLVPLHNACSYGHYEVTELLLKHGACVNAMDLWQFTPLHEAASKNRVEVCSLLLSHGADPTLVNCHGKSAVDMAPTPELRERLTYEFKGHSLLQAAREADLAKVKKTLALEIINFKQPQSHETALHCAVASLHPKRKQVTELLLRKGANVNEKNKDFMTPLHVAAERAHNDVMEVLHKHGAKMNALDTLGQTALHRAALAGHLQTCRLLLSYGSDPSIISLQGFTAAQMGNEAVQQILSESTPIRTSDVDYRLLEASKAGDLETVKQLCSSQNVNCRDLEGRHSTPLHFAAGYNRVSVVEYLLHHGADVHAKDKGGLVPLHNACSYGHYEVAELLVRHGASVNVADLWKFTPLHEAAAKGKYEICKLLLKHGADPTKKNRDGNTPLDLVKEGDTDIQDLLRGDAALLDAAKKGCLARVQKLCTPENINCRDTQGRNSTPLHLAAGYNNLEVAEYLLEHGADVNAQDKGGLIPLHNAASYGHVDIAALLIKYNTCVNATDKWAFTPLHEAAQKGRTQLCALLLAHGADPTMKNQEGQTPLDLATADDIRALLIDAMPPEALPTCFKPQATVVSASLISPASTPSCLSAASSIDNLTGPLAELAVGGASNAGDGAAGTERKEGEVAGLDMNISQFLKSLGLEHLRDIFETEQITLDVLADMGHEELKEIGINAYGHRHKLIKGVERLLGGQQGTNPYLTFHCVNQGTILLDLAPEDKEYQSVEEEMQSTIREHRDGGNAGGIFNRYNVIRIQKVVNKKLRERFCHRQKEVSEENHNHHNERMLFHGSPFINAIIHKGFDERHAYIGGMFGAGIYFAENSSKSNQYVYGIGGGTGCPTHKDRSCYICHRQMLFCRVTLGKSFLQFSTMKMAHAPPGHHSVIGRPSVNGLAYAEYVIYRGEQAYPEYLITYQIMKPEAPSQTATAAEQKT

SEQ ID NO: 86666 - protein, 243 aa, Homo sapiens
  Payload ID: 17346
  Gene Symbol: TNKS
  Gene Name: tankyrase, TRF1-interacting ankyrin-related ADP-ribose polymerase
  ENSP ID: ENSP00000430920
MAASRRSQHHHHHHQQQLQPAPGASAPPPPPPPPLSPGLAPGTTPASPTASGLAPFASPRHGLALPEGDGSRDPPDRPRSPDPVDGTSCCSTTSTICTVAAAPVVPAVSTSSAAGVAPNPAGSGSNNSPSSSSSPTSSSSSSPSSPGSSLAESPEAAGVSSTAPLGPGAAGPGTGVPAVSGALRELLEACRNGDVSRVKRLVDAANVNAKDMAGRKSSPLHFAAGQRLLNCLLRVMGLGAGSG

SEQ ID NO: 86667 - protein, 68 aa, Homo sapiens
  Payload ID: 17346
  Gene Symbol: TNKS
  Gene Name: tankyrase, TRF1-interacting ankyrin-related ADP-ribose polymerase
  ENSP ID: ENSP00000431098
GCLARVQKLCTPENINCRDTQGRNSTPLHLAAGYNNLEVAEYLLEHGADVNAQDKGGLIPLHNAASYG

SEQ ID NO: 86668 - protein, 1166 aa, Homo sapiens
  Payload ID: 17347
  Gene Symbol: TNKS2
  Gene Name: tankyrase, TRF1-interacting ankyrin-related ADP-ribose polymerase 2
  Uniprot ID: Q9H2K2
  ENSP ID: ENSP00000360689
MSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGEYKKDELLESARSGNEEKMMALLTPLNVNCHASDGRKSTPLHLAAGYNRVKIVQLLLQHGADVHAKDKGDLVPLHNACSYGHYEVTELLVKHGACVNAMDLWQFTPLHEAASKNRVEVCSLLLSYGADPTLLNCHNKSAIDLAPTPQLKERLAYEFKGHSLLQAAREADVTRIKKHLSLEMVNFKHPQTHETALHCAAASPYPKRKQICELLLRKGANINEKTKEFLTPLHVASEKAHNDVVEVVVKHEAKVNALDNLGQTSLHRAAYCGHLQTCRLLLSYGCDPNIISLQGFTALQMGNENVQQLLQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGCLARVKKLSSPDNVNCRDTQGRHSTPLHLAAGYNNLEVAEYLLQHGADVNAQDKGGLIPLHNAASYGHVDVAALLIKYNACVNATDKWAFTPLHEAAQKGRTQLCALLLAHGADPTLKNQEGQTPLDLVSADDVSALLTAAMPPSALPSCYKPQVLNGVRSPGATADALSSGPSSPSSLSAASSLDNLSGSFSELSSVVSSSGTEGASSLEKKEVPGVDFSITQFVRNLGLEHLMDIFEREQITLDVLVEMGHKELKEIGINAYGHRHKLIKGVERLISGQQGLNPYLTLNTSGSGTILIDLSPDDKEFQSVEEEMQSTVREHRDGGHAGGIFNRYNILKIQKVCNKKLWERYTHRRKEVSEENHNHANERMLFHGSPFVNAIIHKGFDERHAYIGGMFGAGIYFAENSSKSNQYVYGIGGGTGCPVHKDRSCYICHRQLLFCRVTLGKSFLQFSAMKMAHSPPGHHSVTGRPSVNGLALAEYVIYRGEQAYPEYLITYQIMRPEGMVDG

SEQ ID NO: 86669 - protein, 1001 aa, Homo sapiens
  Payload ID: 17348
  Gene Symbol: TAOK1
  Gene Name: TAO kinase 1
  Uniprot ID: Q7L7X3
  ENSP ID: ENSP00000261716
MPSTNRAGSLKDPEIAELFFKEDPEKLFTDLREIGHGSFGAVYFARDVRTNEVVAIKKMSYSGKQSTEKWQDIIKEVKFLQRIKHPNSIEYKGCYLREHTAWLVMEYCLGSASDLLEVHKKPLQEVEIAAITHGALQGLAYLHSHTMIHRDIKAGNILLTEPGQVKLADFGSASMASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEELNENQSTPKKEKQEWLSKQKENIQHFQAEEEANLLRRQRQYLELECRRFKRRMLLGRHNLEQDLVREELNKRQTQKDLEHAMLLRQHESMQELEFRHLNTIQKMRCELIRLQHQTELTNQLEYNKRRERELRRKHVMEVRQQPKSLKSKELQIKKQFQDTCKIQTRQYKALRNHLLETTPKSEHKAVLKRLKEEQTRKLAILAEQYDHSINEMLSTQALRLDEAQEAECQVLKMQLQQELELLNAYQSKIKMQAEAQHDRELRELEQRVSLRRALLEQKIEEEMLALQNERTERIRSLLERQAREIEAFDSESMRLGFSNMVLSNLSPEAFSHSYPGASGWSHNPTGGPGPHWGHPMGGPPQAWGHPMQGGPQPWGHPSGPMQGVPRGSSMGVRNSPQALRRTASGGRTEQGMSRSTSVTSQISNGSHMSYT

SEQ ID NO: 86670 - protein, 853 aa, Homo sapiens
  Payload ID: 17348
  Gene Symbol: TAOK1
  Gene Name: TAO kinase 1
  Uniprot ID: Q7L7X3
  ENSP ID: ENSP00000438819
MPSTNRAGSLKDPEIAELFFKEDPEKLFTDLREIGHGSFGAVYFARDVRTNEVVAIKKMSYSGKQSTEKWQDIIKEVKFLQRIKHPNSIEYKGCYLREHTAWLVMEYCLGSASDLLEVHKKPLQEVEIAAITHGALQGLAYLHSHTMIHRDIKAGNILLTEPGQVKLADFGSASMASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKESKELQIKKQFQDTCKIQTRQYKALRNHLLETTPKSEHKAVLKRLKEEQTRKLAILAEQYDHSINEMLSTQALRLDEAQEAECQVLKMQLQQELELLNAYQSKIKMQAEAQHDRELRELEQRVSLRRALLEQKIEEEMLALQNERTERIRSLLERQAREIEAFDSESMRLGFSNMVLSNLSPEAFSHSYPGASGWSHNPTGGPGPHWGHPMGGPPQAWGHPMQGGPQPWGHPSGPMQGVPRGSSMGVRNSPQALRRTASGGRTEQGMSRSTSVTSQISNGSHMSYT

SEQ ID NO: 86671 - protein, 79 aa, Homo sapiens
  Payload ID: 17348
  Gene Symbol: TAOK1
  Gene Name: TAO kinase 1
  ENSP ID: ENSP00000464562
MPSTNRAGSLKDPEIAELFFKEDPEKLFTDLREIGHGSFGAVYFARDVRTNEVVAIKKMSYSGKQSTEKWQDIIKEVKF

SEQ ID NO: 86672 - protein, 1049 aa, Homo sapiens
  Payload ID: 17349
  Gene Symbol: TAOK2
  Gene Name: TAO kinase 2
  Uniprot ID: Q9UL54
  ENSP ID: ENSP00000279394
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKSKELQIKKQFQETCKIQTRQYKALRAHLLETTPKAQHKSLLKRLKEEQTRKLAILAEQYDQSISEMLSSQALRLDETQEAEFQALRQQLQQELELLNAYQSKIKIRTESQHERELRELEQRVALRRALLEQRVEEELLALQTGRSERIRSLLERQAREIEAFDAESMRLGFSSMALGGIPAEAAAQGYPAPPPAPAWPSRPVPRSGAHWSHGPPPPGMPPPAWRQPSLLAPPGPPNWLGPPTQSGTPRGGALLLLRNSPQPLRRAASGGSGSENVGPPAAAVPGPLSRSTSVASHILNGSSHFYS

SEQ ID NO: 86673 - protein, 1235 aa, Homo sapiens
  Payload ID: 17349
  Gene Symbol: TAOK2
  Gene Name: TAO kinase 2
  Uniprot ID: Q9UL54
  ENSP ID: ENSP00000310094
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 86674 - protein, 1062 aa, Homo sapiens
  Payload ID: 17349
  Gene Symbol: TAOK2
  Gene Name: TAO kinase 2
  Uniprot ID: Q9UL54
  ENSP ID: ENSP00000393048
MMGTSQGHVARKSRNWGLNPSRLSSIPLSSTPCHLSPSSLSPFSVAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 86675 - protein, 1122 aa, Homo sapiens
  Payload ID: 17349
  Gene Symbol: TAOK2
  Gene Name: TAO kinase 2
  Uniprot ID: Q9UL54
  ENSP ID: ENSP00000440336
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 86676 - protein, 898 aa, Homo sapiens
  Payload ID: 17350
  Gene Symbol: TAOK3
  Gene Name: TAO kinase 3
  Uniprot ID: Q9H2K8
  ENSP ID: ENSP00000376317
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 86677 - protein, 898 aa, Homo sapiens; identical to SEQ ID NO: 86676
  Payload ID: 17350
  Gene Symbol: TAOK3
  Gene Name: TAO kinase 3
  Uniprot ID: Q9H2K8
  ENSP ID: ENSP00000416374

SEQ ID NO: 86678 - protein, 185 aa, Homo sapiens
  Payload ID: 17350
  Gene Symbol: TAOK3
  Gene Name: TAO kinase 3
  ENSP ID: ENSP00000437389
QRLLLERTHCLVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLI

SEQ ID NO: 86679 - protein, 18 aa, Homo sapiens
  Payload ID: 17350
  Gene Symbol: TAOK3
  Gene Name: TAO kinase 3
  ENSP ID: ENSP00000438766
MRKGVLKDPEIADLFYKD

SEQ ID NO: 86680 - protein, 93 aa, Homo sapiens
  Payload ID: 17350
  Gene Symbol: TAOK3
  Gene Name: TAO kinase 3
  ENSP ID: ENSP00000438820
MRKGVLKDPEIADLFYKDDPEELFIGLHEIGHGSFGAVYFATNAHTSEVVAIKKMSYSGKQTHEKWQDILKEVKFLRQLKHPNTIEYKGCYLK

SEQ ID NO: 86681 - protein, 14 aa, Homo sapiens
  Payload ID: 17350
  Gene Symbol: TAOK3
  Gene Name: TAO kinase 3
  ENSP ID: ENSP00000439620
MSGYKRMRRQHQKQ

SEQ ID NO: 86682 - protein, 57 aa, Homo sapiens
  Payload ID: 17350
  Gene Symbol: TAOK3
  Gene Name: TAO kinase 3
  ENSP ID: ENSP00000440315
MRKGVLKDPEIADLFYKDDPEELFIGLHEIGHGSFGAVYFATNAHTSEVVAIKKMSY

SEQ ID NO: 86683 - protein, 36 aa, Homo sapiens
  Payload ID: 17350
  Gene Symbol: TAOK3
  Gene Name: TAO kinase 3
  ENSP ID: ENSP00000441071
MRKGVLKDPEIADLFYKDDPEELFIGLHEIGHGSFG

SEQ ID NO: 86684 - protein, 93 aa, Homo sapiens
  Payload ID: 17350
  Gene Symbol: TAOK3
  Gene Name: TAO kinase 3
  ENSP ID: ENSP00000441932
MELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 86685 - protein, 21 aa, Homo sapiens
  Payload ID: 17350
  Gene Symbol: TAOK3
  Gene Name: TAO kinase 3
  ENSP ID: ENSP00000442541
MRKGVLKDPEIADLFYKDDPE

SEQ ID NO: 86686 - protein, 136 aa, Homo sapiens
  Payload ID: 17350
  Gene Symbol: TAOK3
  Gene Name: TAO kinase 3
  ENSP ID: ENSP00000443465
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLA

SEQ ID NO: 86687 - protein, 38 aa, Homo sapiens
  Payload ID: 17350
  Gene Symbol: TAOK3
  Gene Name: TAO kinase 3
  ENSP ID: ENSP00000443487
MSGYKRMRRQHQKQLIALENKLKAEMDEHRLKLQKEVE

SEQ ID NO: 86688 - protein, 438 aa, Homo sapiens
  Payload ID: 17350
  Gene Symbol: TAOK3
  Gene Name: TAO kinase 3
  ENSP ID: ENSP00000443834
MSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 86689 - protein, 61 aa, Homo sapiens
  Payload ID: 17350
  Gene Symbol: TAOK3
  Gene Name: TAO kinase 3
  ENSP ID: ENSP00000444057
MRKGVLKDPEIADLFYKDDPEELFIGLHEIGHGSFGAVYFATNAHTSEVVAIKKMSYSGKQ

SEQ ID NO: 86690 - protein, 466 aa, Homo sapiens
  Payload ID: 17351
  Gene Symbol: TAPBP
  Gene Name: TAP binding protein (tapasin)
  ENSP ID: ENSP00000363696
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVEMGFHHVGQAALELLTSVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 86691 - protein, 448 aa, Homo sapiens
  Payload ID: 17351
  Gene Symbol: TAPBP
  Gene Name: TAP binding protein (tapasin)
  Uniprot ID: O15533
  ENSP ID: ENSP00000363700
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 86692 - protein, 504 aa, Homo sapiens
  Payload ID: 17351
  Gene Symbol: TAPBP
  Gene Name: TAP binding protein (tapasin)
  ENSP ID: ENSP00000372542
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKVQCSTSLYLSLVTLSPHPISKPMEGGCWCGRQNLGLEFTLIWVKTWHYILTVGLFEHAT

SEQ ID NO: 86693 - protein, 448 aa, Homo sapiens
  Payload ID: 17351
  Gene Symbol: TAPBP
  Gene Name: TAP binding protein (tapasin)
  Uniprot ID: O15533
  ENSP ID: ENSP00000372543
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 86694 - protein, 466 aa, Homo sapiens
  Payload ID: 17351
  Gene Symbol: TAPBP
  Gene Name: TAP binding protein (tapasin)
  ENSP ID: ENSP00000372544
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVEMGFHHVGQAALELLTSVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 86695 - protein, 504 aa, Homo sapiens [sequence omitted]

SEQ ID NO: 86696 - protein, 448 aa, Homo sapiens; identical to SEQ ID NO: 86691
  Payload ID: 17351
  Gene Symbol: TAPBP
  Gene Name: TAP binding protein (tapasin)
  Uniprot ID: O15533
  ENSP ID: ENSP00000372685

SEQ ID NO: 86697 - protein, 504 aa, Homo sapiens [sequence omitted]

SEQ ID NO: 86698 - protein, 156 aa, Homo sapiens
  Payload ID: 17351
  Gene Symbol: TAPBP
  Gene Name: TAP binding protein (tapasin)
  ENSP ID: ENSP00000387803
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSMGHAMPVEFTIPACLPRGAALRSPWR

SEQ ID NO: 86699 - protein, 466 aa, Homo sapiens; identical to SEQ ID NO: 86690
  Payload ID: 17351
  Gene Symbol: TAPBP
  Gene Name: TAP binding protein (tapasin)
  ENSP ID: ENSP00000389692

SEQ ID NO: 86700 - protein, 202 aa, Homo sapiens
  Payload ID: 17351
  Gene Symbol: TAPBP
  Gene Name: TAP binding protein (tapasin)
  ENSP ID: ENSP00000389929
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVY

SEQ ID NO: 86701 - protein, 448 aa, Homo sapiens; identical to SEQ ID NO: 86693
  Payload ID: 17351
  Gene Symbol: TAPBP
  Gene Name: TAP binding protein (tapasin)
  Uniprot ID: O15533
  ENSP ID: ENSP00000395701

SEQ ID NO: 86702 - protein, 202 aa, Homo sapiens
  Payload ID: 17351
  Gene Symbol: TAPBP
  Gene Name: TAP binding protein (tapasin)
  ENSP ID: ENSP00000398088
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVY

SEQ ID NO: 86703 - protein, 448 aa, Homo sapiens; identical to SEQ ID NO: 86691
  Payload ID: 17351
  Gene Symbol: TAPBP
  Gene Name: TAP binding protein (tapasin)
  Uniprot ID: O15533
  ENSP ID: ENSP00000402087

SEQ ID NO: 86704 - protein, 466 aa, Homo sapiens; identical to SEQ ID NO: 86690
  Payload ID: 17351
  Gene Symbol: TAPBP
  Gene Name: TAP binding protein (tapasin)
  ENSP ID: ENSP00000404363

SEQ ID NO: 86705 - protein, 504 aa, Homo sapiens; identical to SEQ ID NO: 86692
  Payload ID: 17351
  Gene Symbol: TAPBP
  Gene Name: TAP binding protein (tapasin)
  ENSP ID: ENSP00000404833

SEQ ID NO: 86706 - protein, 504 aa, Homo sapiens [sequence omitted]

SEQ ID NO: 86707 - protein, 202 aa, Homo sapiens; identical to SEQ ID NO: 86700
  Payload ID: 17351
  Gene Symbol: TAPBP
  Gene Name: TAP binding protein (tapasin)
  ENSP ID: ENSP00000408033

SEQ ID NO: 86708 - protein, 202 aa, Homo sapiens; identical to SEQ ID NO: 86700
  Payload ID: 17351
  Gene Symbol: TAPBP
  Gene Name: TAP binding protein (tapasin)
  ENSP ID: ENSP00000415565

SEQ ID NO: 86709 - protein, 192 aa, Homo sapiens
  Payload ID: 17351
  Gene Symbol: TAPBP
  Gene Name: TAP binding protein (tapasin)
  ENSP ID: ENSP00000417523
MKSLSLLLAVALDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGP

SEQ ID NO: 86710 - protein, 466 aa, Homo sapiens; identical to SEQ ID NO: 86694
  Payload ID: 17351
  Gene Symbol: TAPBP
  Gene Name: TAP binding protein (tapasin)
  ENSP ID: ENSP00000417949

SEQ ID NO: 86711 - protein, 361 aa, Homo sapiens
  Payload ID: 17351
  Gene Symbol: TAPBP
  Gene Name: TAP binding protein (tapasin)
  ENSP ID: ENSP00000419659
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 86712 - protein, 156 aa, Homo sapiens; identical to SEQ ID NO: 86698
  Payload ID: 17351
  Gene Symbol: TAPBP
  Gene Name: TAP binding protein (tapasin)
  ENSP ID: ENSP00000447220

SEQ ID NO: 86713 - protein, 361 aa, Homo sapiens; identical to SEQ ID NO: 86711
  Payload ID: 17351
  Gene Symbol: TAPBP
  Gene Name: TAP binding protein (tapasin)
  ENSP ID: ENSP00000447665

SEQ ID NO: 86714 - protein, 448 aa, Homo sapiens
  Payload ID: 17351
  Gene Symbol: TAPBP
  Gene Name: TAP binding protein (tapasin)
  ENSP ID: ENSP00000447823
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKHAT

SEQ ID NO: 86715 - protein, 156 aa, Homo sapiens; identical to SEQ ID NO: 86698
  Payload ID: 17351
  Gene Symbol: TAPBP
  Gene Name: TAP binding protein (tapasin)
  ENSP ID: ENSP00000447932

SEQ ID NO: 86716 - protein, 448 aa, Homo sapiens; identical to SEQ ID NO: 86714
  Payload ID: 17351
  Gene Symbol: TAPBP
  Gene Name: TAP binding protein (tapasin)
  ENSP ID: ENSP00000448168

SEQ ID NO: 86717 - protein, 448 aa, Homo sapiens; identical to SEQ ID NO: 86714
  Payload ID: 17351
  Gene Symbol: TAPBP
  Gene Name: TAP binding protein (tapasin)
  ENSP ID: ENSP00000450358

SEQ ID NO: 86718 - protein, 468 aa, Homo sapiens
  Payload ID: 17352
  Gene Symbol: TAPBPL
  Gene Name: TAP binding protein-like
  Uniprot ID: Q9BX59
  ENSP ID: ENSP00000266556
MGTQEGWCLLLCLALSGAAETKPHPAEGQWRAVDVVLDCFLAKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANMQVSGGGPSISLVMKTPRVTKNEALWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 86719 - protein, 185 aa, Homo sapiens
  Payload ID: 17352
  Gene Symbol: TAPBPL
  Gene Name: TAP binding protein-like
  ENSP ID: ENSP00000445341
MGTQEGWCLLLCLALSGAAETMDLVQIPQAEALLHADCSGKEVTCEISRYFLQMTETTVKTAAWFMANMQVSGGGPSISLVMKTPRVTKNEALWHPTLNLPLSPQGTVRTAVEFQVMTQTQSLSFLLGSSASLDCGFSMAPGLDLISVEWRLQHKGRGRGDLHLPDHHLSVPSSADHPAQHPSFP

SEQ ID NO: 86720 - protein, 537 aa, Homo sapiens
  Payload ID: 17353
  Gene Symbol: TPRN
  Gene Name: taperin
  ENSP ID: ENSP00000327617
NSFTVHPRGLHRGAGARLLSNGHSAPEPRAGPANRLAGSPPGSGQWKPKVESGDPSLHPPPSPGTPSATPASPPASATPSQRQCVSAATSTNDSFEIRPAPKPVMETIPLGDLQARALASLRANSRNSFMVIPKSKASGAPPPEGRQSVELPKGDLGPASPSQELGSQPVPGGDGAPALGKSPLEVEAQWAVEEGACPRTATALADRAIRWQRPSSPPPFLPAASEEAEPAEGLRVPGLAKNSREYVRPGLPVTFIDEVDSEEAPQAAKLPYLPHPARPLHPARPGCVAELQPRGSNTFTVVPKRKPGTLQDQHFSQANREPRPREAEEEEASCLLGPTLKKRYPTVHEIEVIGGYLALQKSCLTKAGSSRKKMKISFNDKSLQTTFEYPSESSLEQEEEVDQQEEEEEEEEEEEEEEEGSGSEEKPFALFLPRATFVSSVRPESSRLPEGSSGLSSYTPKHSVAFSKWQEQALEQAPREAEPPPVEAMVRCGGVERWGESDTRASPCVHILSSHFQLTPASQNDLSDFRSEPALYF

SEQ ID NO: 86721 - protein, 711 aa, Homo sapiens
  Payload ID: 17353
  Gene Symbol: TPRN
  Gene Name: taperin
  Uniprot ID: Q4KMQ1
  ENSP ID: ENSP00000387100
MAALGRPGSGPRAAVPAWKREILERKRAKLAALGGGAGPGAAEPEQRVLAESLGPLRENPFMLLEAERRRGGGAAGARLLERYRRVPGVRALRADSVLIIETVPGFPPAPPAPGAAQIRAAEVLVYGAPPGRVSRLLERFDPPAAPRRRGSPERARPPPPPPPPAPPRPPPAAPSPPAAPGPRGGGASPGARRSDFLQKTGSNSFTVHPRGLHRGAGARLLSNGHSAPEPRAGPANRLAGSPPGSGQWKPKVESGDPSLHPPPSPGTPSATPASPPASATPSQRQCVSAATSTNDSFEIRPAPKPVMETIPLGDLQARALASLRANSRNSFMVIPKSKASGAPPPEGRQSVELPKGDLGPASPSQELGSQPVPGGDGAPALGKSPLEVEAQWAVEEGACPRTATALADRAIRWQRPSSPPPFLPAASEEAEPAEGLRVPGLAKNSREYVRPGLPVTFIDEVDSEEAPQAAKLPYLPHPARPLHPARPGCVAELQPRGSNTFTVVPKRKPGTLQDQHFSQANREPRPREAEEEEASCLLGPTLKKRYPTVHEIEVIGGYLALQKSCLTKAGSSRKKMKISFNDKSLQTTFEYPSESSLEQEEEVDQQEEEEEEEEEEEEEEEGSGSEEKPFALFLPRATFVSSVRPESSRLPEGSSGLSSYTPKHSVAFSKWQEQALEQAPREAEPPPVEAMLTPASQNDLSDFRSEPALYF

SEQ ID NO: 86722 - protein, 1621 aa, Homo sapiens
  Payload ID: 17354
  Gene Symbol: TARBP1
  Gene Name: TAR (HIV-1) RNA binding protein 1
  Uniprot ID: Q13395
  ENSP ID: ENSP00000040877
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 86723 - protein, 366 aa, Homo sapiens
  Payload ID: 17355
  Gene Symbol: TARBP2
  Gene Name: TAR (HIV-1) RNA binding protein 2
  Uniprot ID: Q15633
  ENSP ID: ENSP00000266987
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 86724 - protein, 345 aa, Homo sapiens
  Payload ID: 17355
  Gene Symbol: TARBP2
  Gene Name: TAR (HIV-1) RNA binding protein 2
  Uniprot ID: Q15633
  ENSP ID: ENSP00000377885
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 86725 - protein, 345 aa, Homo sapiens; identical to SEQ ID NO: 86724
  Payload ID: 17355
  Gene Symbol: TARBP2
  Gene Name: TAR (HIV-1) RNA binding protein 2
  Uniprot ID: Q15633
  ENSP ID: ENSP00000416077

SEQ ID NO: 86726 - protein, 92 aa, Homo sapiens
  Payload ID: 17355
  Gene Symbol: TARBP2
  Gene Name: TAR (HIV-1) RNA binding protein 2
  ENSP ID: ENSP00000447262
MLAANPGKTPISLLQEYGTRIGKTPVYDLLKAEGQAHQPNFTFRVTVGDTSCTGQGPSKKAAKHKAAEVALKHLKGGSMLEPALEDSRLFTA

SEQ ID NO: 86727 - protein, 227 aa, Homo sapiens
  Payload ID: 17355
  Gene Symbol: TARBP2
  Gene Name: TAR (HIV-1) RNA binding protein 2
  ENSP ID: ENSP00000447767
  MOD_RES (1)..(1): Any amino acid
XPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGCGLPPGWSSKPGPRLHLGFSTKFSRREDPVPPQLLPGLPGCPGPCLLPCPQ

SEQ ID NO: 86728 - protein, 94 aa, Homo sapiens
  Payload ID: 17355
  Gene Symbol: TARBP2
  Gene Name: TAR (HIV-1) RNA binding protein 2
  ENSP ID: ENSP00000447993
MSEEEQGSGTTTGCGLPSLLQEYGTRIGKTPVYDLLKAEGQAHQPNFTFRVTVGDTSCTGQGPSKKAAKHKAAEVALKHLKGGSMLEPALEDSR

SEQ ID NO: 86729 - protein, 196 aa, Homo sapiens
  Payload ID: 17355
  Gene Symbol: TARBP2
  Gene Name: TAR (HIV-1) RNA binding protein 2
  ENSP ID: ENSP00000448199
MLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACC

SEQ ID NO: 86730 - protein, 88 aa, Homo sapiens
  Payload ID: 17355
  Gene Symbol: TARBP2
  Gene Name: TAR (HIV-1) RNA binding protein 2
  ENSP ID: ENSP00000448943
MLAANPGKTPISLLQEYGTRIGKTPVYDLLKAEGQAHQPNFTFRVTVGDTSCTGQGPSKKAAKHKAAEVALKHLKGGSMLEPALEDSR

SEQ ID NO: 86731 - protein, 187 aa, Homo sapiens
  Payload ID: 17355
  Gene Symbol: TARBP2
  Gene Name: TAR (HIV-1) RNA binding protein 2
  ENSP ID: ENSP00000448948
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQSLRLLRGDQRGCEKPFFTQPHAPCVSLPRSWWCRKAGGCRSTQ

SEQ ID NO: 86732 - protein, 165 aa, Homo sapiens
  Payload ID: 17355
  Gene Symbol: TARBP2
  Gene Name: TAR (HIV-1) RNA binding protein 2
  ENSP ID: ENSP00000449537
MSEEEQGSGTTTGCGLPSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGCGLPPGWSSKPGPRLHLGFSTKFSRREDPVPPQLLPGLPGCPGPCLLPCPQ

SEQ ID NO: 86733 - protein, 113 aa, Homo sapiens
  Payload ID: 17355
  Gene Symbol: TARBP2
  Gene Name: TAR (HIV-1) RNA binding protein 2
  ENSP ID: ENSP00000450320
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSRLFTA

SEQ ID NO: 86734 - protein, 160 aa, Homo sapiens
  Payload ID: 17355
  Gene Symbol: TARBP2
  Gene Name: TAR (HIV-1) RNA binding protein 2
  ENSP ID: ENSP00000458011
MLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNR

SEQ ID NO: 86735 - protein, 414 aa, Homo sapiens
  Payload ID: 17356
  Gene Symbol: TARDBP
  Gene Name: TAR DNA binding protein
  Uniprot ID: Q13148
  ENSP ID: ENSP00000240185
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 86736 - protein, 295 aa, Homo sapiens
  Payload ID: 17356
  Gene Symbol: TARDBP
  Gene Name: TAR DNA binding protein
  ENSP ID: ENSP00000313129
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGVHLISNVYGRSTSLKVVL

SEQ ID NO: 86737 - protein, 84 aa, Homo sapiens
  Payload ID: 17356
  Gene Symbol: TARDBP
  Gene Name: TAR DNA binding protein
  ENSP ID: ENSP00000404666
MSEYIRVTEDENDEPIEIPSEDDGTVLLSTVTAQFPGACGLRYRNPVSQCMRGVRLVEGILHAPDAGWGNLVYVVNYPKGQERS

SEQ ID NO: 86738 - protein, 298 aa, Homo sapiens; identical to SEQ ID NO: 76003
  Payload ID: 17356
  Gene Symbol: TARDBP
  Gene Name: TAR DNA binding protein
  ENSP ID: ENSP00000432132

SEQ ID NO: 86739 - protein, 80 aa, Homo sapiens
  Payload ID: 17356
  Gene Symbol: TARDBP
  Gene Name: TAR DNA binding protein
  ENSP ID: ENSP00000465080
MSEYIRVTEDENDEPIEIPSEDDGTVLLSTVTAQFPGACGLRYRNPVSQCMRGVRLVEGILHAPDAGWGNLVYVVNYPKV

SEQ ID NO: 86740 - protein, 201 aa, Homo sapiens
  Payload ID: 17356
  Gene Symbol: TARDBP
  Gene Name: TAR DNA binding protein
  ENSP ID: ENSP00000465240
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTED

SEQ ID NO: 86741 - protein, 65 aa, Homo sapiens
  Payload ID: 17356
  Gene Symbol: TARDBP
  Gene Name: TAR DNA binding protein
  ENSP ID: ENSP00000465888
  MOD_RES (1)..(1): Any amino acid
XADDQIAQSLCGEDLIIKGISVHISNAEPKHNSNRQLERSGRFGGNPVHLISNVYGRSTSLKVVL

SEQ ID NO: 86742 - protein, 275 aa, Homo sapiens
  Payload ID: 17356
  Gene Symbol: TARDBP
  Gene Name: TAR DNA binding protein
  ENSP ID: ENSP00000466842
MSEYIRVTEDENDEPIEIPSEDDGTVLLSTVTAQFPGACGLRYRNPVSQCMRGVRLVEGILHAPDAGWGNLVYVVNYPKGWTWWLTSVIPATREAEAGESLEPGRQRLQRGEIAPLHSSLDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTF

SEQ ID NO: 86743 - protein, 16 aa, Homo sapiens
  Payload ID: 17356
  Gene Symbol: TARDBP
  Gene Name: TAR DNA binding protein
  ENSP ID: ENSP00000467020
LISNVYGRSTSLKVVL

SEQ ID NO: 86744 - protein, 35 aa, Homo sapiens
  Payload ID: 17356
  Gene Symbol: TARDBP
  Gene Name: TAR DNA binding protein
  ENSP ID: ENSP00000477852
  MOD_RES (1)..(1): Any amino acid
XAAIGWGSASNAGSGSGFNGGFGSSMDSKSSGWGM

SEQ ID NO: 86745 - protein, 212 aa, Homo sapiens
  Payload ID: 17356
  Gene Symbol: TARDBP
  Gene Name: TAR DNA binding protein
  ENSP ID: ENSP00000479219
  MOD_RES (1)..(1): Any amino acid
XTDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPVHLISNVYGRSTSLKVVL

SEQ ID NO: 86746 - protein, 115 aa, Homo sapiens
  Payload ID: 17356
  Gene Symbol: TARDBP
  Gene Name: TAR DNA binding protein
  ENSP ID: ENSP00000479758
  MOD_RES (1)..(1): Any amino acid
XNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 86747 - protein, 138 aa, Homo sapiens
  Payload ID: 17356
  Gene Symbol: TARDBP
  Gene Name: TAR DNA binding protein
  ENSP ID: ENSP00000479978
  MOD_RES (1)..(1): Any amino acid
XRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPVQYEAFI

SEQ ID NO: 86748 - protein, 243 aa, Homo sapiens
  Payload ID: 17356
  Gene Symbol: TARDBP
  Gene Name: TAR DNA binding protein
  ENSP ID: ENSP00000480690
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKIAQSLCGEDLIIKGISVHISNAEPKHNSNRQLERSGRFGGNPGGFGNQGGFGNSRGGGAGLG

SEQ ID NO: 86749 - protein, 149 aa, Homo sapiens
  Payload ID: 17356
  Gene Symbol: TARDBP
  Gene Name: TAR DNA binding protein
  ENSP ID: ENSP00000480771
  MOD_RES (1)..(1): Any amino acid
XRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPVHLISNVYGRSTSLKVVL

SEQ ID NO: 86750 - protein, 200 aa, Homo sapiens
  Payload ID: 17356
  Gene Symbol: TARDBP
  Gene Name: TAR DNA binding protein
  ENSP ID: ENSP00000481206
  MOD_RES (1)..(1): Any amino acid
XDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGVQYEAFI

SEQ ID NO: 86751 - protein, 175 aa, Homo sapiens
  Payload ID: 17356
  Gene Symbol: TARDBP
  Gene Name: TAR DNA binding protein
  ENSP ID: ENSP00000481330
KEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGVHLISNVYGRSTSLKVVL

SEQ ID NO: 86752 - protein, 304 aa, Homo sapiens
  Payload ID: 17356
  Gene Symbol: TARDBP
  Gene Name: TAR DNA binding protein
  ENSP ID: ENSP00000482191
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQVHLISNVYGRSTSLKVVL

SEQ ID NO: 86753 - protein, 127 aa, Homo sapiens
  Payload ID: 17356
  Gene Symbol: TARDBP
  Gene Name: TAR DNA binding protein
  ENSP ID: ENSP00000482559
CKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGILSTCFLIQEFVITHHRPRL

SEQ ID NO: 86754 - protein, 78 aa, Homo sapiens
  Payload ID: 17356
  Gene Symbol: TARDBP
  Gene Name: TAR DNA binding protein
  ENSP ID: ENSP00000482754
  MOD_RES (1)..(1): Any amino acid
XQDEPLRSRKVFVGRCTEDMTEDELREFFSQYGDVMDVFIPKPFRAFAFVTFADDQIAQSLCGEDLIIKGISVHKSTI

SEQ ID NO: 86755 - protein, 301 aa, Homo sapiens
  Payload ID: 17356
  Gene Symbol: TARDBP
  Gene Name: TAR DNA binding protein
  ENSP ID: ENSP00000484722
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGILSTCFLIQEFVITHHRPRL

SEQ ID NO: 86756 - protein, 298 aa, Homo sapiens; identical to SEQ ID NO: 76003
  Payload ID: 17356
  Gene Symbol: TARDBP
  Gene Name: TAR DNA binding protein
  ENSP ID: ENSP00000486989

SEQ ID NO: 86757 - protein, 510 aa, Homo sapiens
  Payload ID: 17357
  Gene Symbol: TOE1
  Gene Name: target of EGR1, member 1 (nuclear)
  Uniprot ID: Q96GM8
  ENSP ID: ENSP00000361162
MAADSDDGAVSAPAASDGGVSKSTTSGEELVVQVPVVDVQSNNFKEMWPSLLLAIKTANFVAVDTELSGLGDRKSLLNQCIEERYKAVCHAARTRSILSLGLACFKRQPDKGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKCERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 86758 - protein, 399 aa, Homo sapiens
  Payload ID: 17358
  Gene Symbol: TOM1L1
  Gene Name: target of myb1 like 1 membrane trafficking protein
  Uniprot ID: O75674
  ENSP ID: ENSP00000343901
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 86759 - protein, 465 aa, Homo sapiens
  Payload ID: 17358
  Gene Symbol: TOM1L1
  Gene Name: target of myb1 like 1 membrane trafficking protein
  ENSP ID: ENSP00000408958
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNPVSLQTIAAAPSNQSLPPLPSNHPAMTKSDLQPPNYYEVMEFDPLAPAVTTEAIYEEIDAHQHKGAQNDGD

SEQ ID NO: 86760 - protein, 399 aa, Homo sapiens; identical to SEQ ID NO: 86758
  Payload ID: 17358
  Gene Symbol: TOM1L1
  Gene Name: target of myb1 like 1 membrane trafficking protein
  Uniprot ID: O75674
  ENSP ID: ENSP00000443099

SEQ ID NO: 86761 - protein, 63 aa, Homo sapiens
  Payload ID: 17358
  Gene Symbol: TOM1L1
  Gene Name: target of myb1 like 1 membrane trafficking protein
  ENSP ID: ENSP00000458219
MAFGKSHRDPYATSVGHLIEKATFAGVQTEDWGQFMHICDIINTTQDGLLTCVCRTVVQVSSL

SEQ ID NO: 86762 - protein, 346 aa, Homo sapiens
  Payload ID: 17358
  Gene Symbol: TOM1L1
  Gene Name: target of myb1 like 1 membrane trafficking protein
  Uniprot ID: O75674
  ENSP ID: ENSP00000458553
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLSK

SEQ ID NO: 86763 - protein, 252 aa, Homo sapiens
  Payload ID: 17358
  Gene Symbol: TOM1L1
  Gene Name: target of myb1 like 1 membrane trafficking protein
  ENSP ID: ENSP00000458809
  MOD_RES (1)..(1): Any amino acid
XKSHRDPYATSVGHLIEKATFAGVQTEDWGQFMHICDIINTTQDGPKDAVKALKKRISKNYNHKEIQLTLSTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATN

SEQ ID NO: 86764 - protein, 346 aa, Homo sapiens; identical to SEQ ID NO: 86762
  Payload ID: 17358
  Gene Symbol: TOM1L1
  Gene Name: target of myb1 like 1 membrane trafficking protein
  Uniprot ID: O75674
  ENSP ID: ENSP00000458918

SEQ ID NO: 86765 - protein, 106 aa, Homo sapiens
  Payload ID: 17358
  Gene Symbol: TOM1L1
  Gene Name: target of myb1 like 1 membrane trafficking protein
  ENSP ID: ENSP00000459003
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPA

SEQ ID NO: 86766 - protein, 38 aa, Homo sapiens
  Payload ID: 17358
  Gene Symbol: TOM1L1
  Gene Name: target of myb1 like 1 membrane trafficking protein
  ENSP ID: ENSP00000459079
MAFGKSHRDPYATSVGHLIAQTQQLFLGRKGYICWSSD

SEQ ID NO: 86767 - protein, 229 aa, Homo sapiens
  Payload ID: 17358
  Gene Symbol: TOM1L1
  Gene Name: target of myb1 like 1 membrane trafficking protein
  ENSP ID: ENSP00000460213
MPPGEWNQTEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELL

SEQ ID NO: 86768 - protein, 92 aa, Homo sapiens
  Payload ID: 17358
  Gene Symbol: TOM1L1
  Gene Name: target of myb1 like 1 membrane trafficking protein
  ENSP ID: ENSP00000460565
MAFGKSHRDPYATSVGHLIEKATFAGVQTEDWGQFMHICDIINTTQDGPKDAVKALKKRISKNYNHKEIQLTLSSRCLLTCVCRTVVQVSSL

SEQ ID NO: 86769 - protein, 225 aa, Homo sapiens
  Payload ID: 17358
  Gene Symbol: TOM1L1
  Gene Name: target of myb1 like 1 membrane trafficking protein
  ENSP ID: ENSP00000460721
MHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQVLYDFRDYQSKCLLKLFSKL

SEQ ID NO: 86770 - protein, 476 aa, Homo sapiens
  Payload ID: 17358
  Gene Symbol: TOM1L1
  Gene Name: target of myb1 like 1 membrane trafficking protein
  Uniprot ID: O75674
  ENSP ID: ENSP00000460823
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 86771 - protein, 199 aa, Homo sapiens
  Payload ID: 17358
  Gene Symbol: TOM1L1
  Gene Name: target of myb1 like 1 membrane trafficking protein
  ENSP ID: ENSP00000461215
  MOD_RES (1)..(1): Any amino acid
XFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQEIGKLHSELDMVKMNVRVMSAILMENTPGSENHED

SEQ ID NO: 86772 - protein, 469 aa, Homo sapiens
  Payload ID: 17358
  Gene Symbol: TOM1L1
  Gene Name: target of myb1 like 1 membrane trafficking protein
  ENSP ID: ENSP00000461284
MAFGKSHRDPYATSVGHLIEKATFAGVQTEDWGQFMHICDIINTTQDGPKDAVKALKKRISKNYNHKEIQLTLSNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 86773 - protein, 122 aa, Homo sapiens
  Payload ID: 17358
  Gene Symbol: TOM1L1
  Gene Name: target of myb1 like 1 membrane trafficking protein
  ENSP ID: ENSP00000461396
MHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSE

SEQ ID NO: 86774 - protein, 326 aa, Homo sapiens
  Payload ID: 17358
  Gene Symbol: TOM1L1
  Gene Name: target of myb1 like 1 membrane trafficking protein
  ENSP ID: ENSP00000461876
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPRDLVLPCWPGCGLKLLTYGDLPTSAS

SEQ ID NO: 86775 - protein, 125 aa, Homo sapiens
  Payload ID: 17358
  Gene Symbol: TOM1L1
  Gene Name: target of myb1 like 1 membrane trafficking protein
  ENSP ID: ENSP00000467227
  MOD_RES (1)..(1): Any amino acid
XFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEYIFQLQTYVRRI

SEQ ID NO: 86776 - protein, 462 aa, Homo sapiens
  Payload ID: 17359
  Gene Symbol: TOM1L2
  Gene Name: target of myb1 like 2 membrane trafficking protein
  Uniprot ID: Q6ZVM7
  ENSP ID: ENSP00000312860
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 86777 - protein, 507 aa, Homo sapiens
  Payload ID: 17359
  Gene Symbol: TOM1L2
  Gene Name: target of myb1 like 2 membrane trafficking protein
  Uniprot ID: Q6ZVM7
  ENSP ID: ENSP00000368818
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 86778 - protein, 462 aa, Homo sapiens; identical to SEQ ID NO: 86776
  Payload ID: 17359
  Gene Symbol: TOM1L2
  Gene Name: target of myb1 like 2 membrane trafficking protein
  Uniprot ID: Q6ZVM7
  ENSP ID: ENSP00000379088

SEQ ID NO: 86779 - protein, 389 aa, Homo sapiens
  Payload ID: 17359
  Gene Symbol: TOM1L2
  Gene Name: target of myb1 like 2 membrane trafficking protein
  ENSP ID: ENSP00000437655
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGKGDDLEEGVTSEEFDKFLEERAKAAEMVPDLPSPPMEAPAPASNPSGRKKPERSEDALFAL

SEQ ID NO: 86780 - protein, 483 aa, Homo sapiens
  Payload ID: 17359
  Gene Symbol: TOM1L2
  Gene Name: target of myb1 like 2 membrane trafficking protein
  Uniprot ID: Q6ZVM7
  ENSP ID: ENSP00000438621
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEELKRKGVEFPMADLDALSPIHTPQRIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGTFLSSAQKRGRGGESDLEPIDSWLITQGMIPVAQPSVMDDIEVWLRTDLKGDDLEEGVTSEEFDKFLEERAKAAEMVPDLPSPPMEAPAPASNPSGRKKPERSEDALFAL

SEQ ID NO: 86781 - protein, 388 aa, Homo sapiens
  Payload ID: 17359
  Gene Symbol: TOM1L2
  Gene Name: target of myb1 like 2 membrane trafficking protein
  ENSP ID: ENSP00000445188
MEFLLGNPFSTPVGQCLEKATDGSLQSEDWTLNMEICDIINETEEGPKDAIRALKKRLNGNRNYREVMLALTIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGTFLSSAQKRGRGGESDLEPIDSWLITQGMIPVAQPSVMDDIEVWLRTDLKGDDLEEGVTSEEFDKFLEERAKAAEMVPDLPSPPMEAPAPASNPSGRKKPERSEDALFAL

SEQ ID NO: 86782 - protein, 240 aa, Homo sapiens
  Payload ID: 17359
  Gene Symbol: TOM1L2
  Gene Name: target of myb1 like 2 membrane trafficking protein
  Uniprot ID: Q6ZVM7
  ENSP ID: ENSP00000463313
MQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 86783 - protein, 457 aa, Homo sapiens
  Payload ID: 17359
  Gene Symbol: TOM1L2
  Gene Name: target of myb1 like 2 membrane trafficking protein
  Uniprot ID: Q6ZVM7
  ENSP ID: ENSP00000464297
MEFLLGNPFSTPVGQCLEKATDGSLQSEDWTLNMEICDIINETEEGPKDAIRALKKRLNGNRNYREVMLALTAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 86784 - protein, 39 aa, Homo sapiens
  Payload ID: 17359
  Gene Symbol: TOM1L2
  Gene Name: target of myb1 like 2 membrane trafficking protein
  ENSP ID: ENSP00000465677
DMFAQTRGNSLAEQRKTHHPAWPLIHRRSLEAGGCSHAG

SEQ ID NO: 86785 - protein, 83 aa, Homo sapiens
  Payload ID: 17359
  Gene Symbol: TOM1L2
  Gene Name: target of myb1 like 2 membrane trafficking protein
  ENSP ID: ENSP00000466863
MEICDIINETEEGPKDAIRALKKRLNGNRNYREVMLALTVLETCVKNCGHRFHILVANRDFIDSVLVKIISPKNNPPTIVQDK

SEQ ID NO: 86786 - protein, 209 aa, Homo sapiens
  Payload ID: 17360
  Gene Symbol: TOM1
  Gene Name: target of myb1 membrane trafficking protein
  ENSP ID: ENSP00000371465
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPRGPCSTQRHNQDRILWALTPASKRTLASMLPLCPPRPYSPVTRP

SEQ ID NO: 86787 - protein, 133 aa, Homo sapiens
  Payload ID: 17360
  Gene Symbol: TOM1
  Gene Name: target of myb1 membrane trafficking protein
  ENSP ID: ENSP00000379085
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQLARSDRCGHHL

SEQ ID NO: 86788 - protein, 69 aa, Homo sapiens
  Payload ID: 17360
  Gene Symbol: TOM1
  Gene Name: target of myb1 membrane trafficking protein
  ENSP ID: ENSP00000385906
MDFLLGNPFSSPVGQRIEKATDGSLQSEDWALNMEICDIINETEEGDSAAGGPGATGCESLLSNGLGRF

SEQ ID NO: 86789 - protein, 151 aa, Homo sapiens
  Payload ID: 17360
  Gene Symbol: TOM1
  Gene Name: target of myb1 membrane trafficking protein
  ENSP ID: ENSP00000389789
MEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTD

SEQ ID NO: 86790 - protein, 97 aa, Homo sapiens
  Payload ID: 17360
  Gene Symbol: TOM1
  Gene Name: target of myb1 membrane trafficking protein
  ENSP ID: ENSP00000390429
MDFLLGNPFSSPVGQRIEKATDGSLQSEDWALNMEICDIINETEEGCSTAPLGPPGLRNLCQELRAPLPRAGGQPGLRGECAGEDHPAQEQPTHHRA

SEQ ID NO: 86791 - protein, 334 aa, Homo sapiens
  Payload ID: 17360
  Gene Symbol: TOM1
  Gene Name: target of myb1 membrane trafficking protein
  ENSP ID: ENSP00000393714
MDFLLGNPFSSPVGQRIEKATDGSLQSEDWALNMEICDIINETEEGPKDALRAVKKRIVGNKNFHEVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLA

SEQ ID NO: 86792 - protein, 492 aa, Homo sapiens
  Payload ID: 17360
  Gene Symbol: TOM1
  Gene Name: target of myb1 membrane trafficking protein
  Uniprot ID: O60784
  ENSP ID: ENSP00000394466
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 86793 - protein, 447 aa, Homo sapiens
  Payload ID: 17360
  Gene Symbol: TOM1
  Gene Name: target of myb1 membrane trafficking protein
  Uniprot ID: O60784
  ENSP ID: ENSP00000394924
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 86794 - protein, 83 aa, Homo sapiens
  Payload ID: 17360
  Gene Symbol: TOM1
  Gene Name: target of myb1 membrane trafficking protein
  ENSP ID: ENSP00000394944
MDFLLGNPFSSPVGQRIEKATDGSLQSEDWALNMEICDIINETEEGPKDALRAVKKRIVGNKNFHEVMLALTVLDGTSRPSRS

SEQ ID NO: 86795 - protein, 25 aa, Homo sapiens
  Payload ID: 17360
  Gene Symbol: TOM1
  Gene Name: target of myb1 membrane trafficking protein
  ENSP ID: ENSP00000397492
MDFLLGNPFSSPVGQRIVPKMPSEQ

SEQ ID NO: 86796 - protein, 460 aa, Homo sapiens
  Payload ID: 17360
  Gene Symbol: TOM1
  Gene Name: target of myb1 membrane trafficking protein
  Uniprot ID: O60784
  ENSP ID: ENSP00000398876
MEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEGKFDKFLEERAKAADRLPNLSSPSAEGPPGPPSGPAPRKKTQEKDDDMLFAL

SEQ ID NO: 86797 - protein, 493 aa, Homo sapiens
  Payload ID: 17360
  Gene Symbol: TOM1
  Gene Name: target of myb1 membrane trafficking protein
  Uniprot ID: O60784
  ENSP ID: ENSP00000413697
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEGKFDKFLEERAKAADRLPNLSSPSAEGPPGPPSGPAPRKKTQEKDDDMLFAL

SEQ ID NO: 86798 - protein, 134 aa, Homo sapiens
  Payload ID: 17360
  Gene Symbol: TOM1
  Gene Name: target of myb1 membrane trafficking protein
  ENSP ID: ENSP00000476698
MEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQR

SEQ ID NO: 86799 - protein, 125 aa, Homo sapiens
  Payload ID: 17360
  Gene Symbol: TOM1
  Gene Name: target of myb1 membrane trafficking protein
  ENSP ID: ENSP00000477471
MEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDM

SEQ ID NO: 86800 - protein, 420 aa, Homo sapiens
  Payload ID: 17361
  Gene Symbol: TASP1
  Gene Name: taspase, threonine aspartase, 1
  Uniprot ID: Q9H6P5
  ENSP ID: ENSP00000338624
MTMEKGMSSGEGLPSRSSQVSAGKITAKELETKQSYKEKRGGFVLVHAGAGYHSESKAKEYKHVCKRACQKAIEKLQAGALATDAVTAALVELEDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFISSPFLASEDGVLGGVIVLRSCRCSAEPDSSQNKQTLLVEFLWSHTTESMCVGYMSAQDGKAKTHISRLPPGAVAGQSVAIEGGVCRLESPVN

SEQ ID NO: 86801 - protein, 110 aa, Homo sapiens
  Payload ID: 17361
  Gene Symbol: TASP1
  Gene Name: taspase, threonine aspartase, 1
  ENSP ID: ENSP00000387574
  MOD_RES (1)..(1): Any amino acid
XKITAKELETKQSYKEKRGGFVLVHAGAGYHSESKAKEYKHVCKRACQKAIEKLQAGALATDAVTAALVELELMWKGQFQVLCVLTNLFLDIIKNPTKTKFKTISNVKVY

SEQ ID NO: 86802 - protein, 305 aa, Homo sapiens
  Payload ID: 17361
  Gene Symbol: TASP1
  Gene Name: taspase, threonine aspartase, 1
  ENSP ID: ENSP00000400580
MTMEKGMSSGEGLPSRSSQVSAGKITAKELETKQSYKEKRGGFVLVHAGAGYHSESKAKEYKHVCKRACQKDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFI

SEQ ID NO: 86803 - protein, 587 aa, Homo sapiens
  Payload ID: 17362
  Gene Symbol: TAS1R1
  Gene Name: taste receptor, type 1, member 1
  Uniprot ID: Q7RTX1
  ENSP ID: ENSP00000312558
MLLCTARLVGLQLLISCCWAFACHSTESSPDFTLPGDYLLAGLFPLHSGCLQVRHRPEVTLCDRSCSFNEHGYHLFQAMRLGVEEINNSTALLPNITLGYQLYDVCSDSANVYATLRVLSLPGQHHIELQGDLLHYSPTVLAVIGPDSTNRAATTAALLSPFLVPMLLEQIHKVHFLLHKDTVAFNDNRDPLSSYNIIAWDWNGPKWTFTVLGSSTWSPVQLNINETKIQWHGKDNQVPKSVCSSDCLEGHQRVVTGFHHCCFECVPCGAGTFLNKSDLYRCQPCGKEEWAPEGSQTCFPRTVVFLALREHTSWVLLAANTLLLLLLLGTAGLFAWHLDTPVVRSAGGRLCFLMLGSLAAGSGSLYGFFGEPTRPACLLRQALFALGFTIFLSCLTVRSFQLIIIFKFSTKVPTFYHAWVQNHGAGLFVMISSAAQLLICLTWLVVWTPLPAREYQRFPHLVMLECTETNSLGFILAFLYNGLLSISAFACSYLGKDLPENYNEAKCVTFSLLFNFVSWIAFFTTASVYDGKYLPAANMMAGLSSLSSGFGGYFLPKCYVILCRPDLNSTEHFQASIQDYTRRCGST

SEQ ID NO: 86804 - protein, 304 aa, Homo sapiens
  Payload ID: 17362
  Gene Symbol: TAS1R1
  Gene Name: taste receptor, type 1, member 1
  ENSP ID: ENSP00000327705
MRLGVEEINNSTALLPNITLGYQLYDVCSDSANVYATLRVLSLPGQHHIELQGDLLHYSPTVLAVIGPDSTNRAATTAALLSPFLVPMISYAASSETLSVKRQYPSFLRTIPNDKYQVETMVLLLQKFGWTWISLVGSSDDYGQLGVQALENQATGQGICIAFKDIMPFSAQVGDERMQCLMRHLAQAGATVVVVFSSRQLARVFFESVVLTNLTGKVWVASEAWALSRHITGVPGIQRIGMVLGVAIQKRAVPGLKAFEEPMPGQTRRPLGLATRAPGAAAISSAENAKLSWHTRCPSSKPSP

SEQ ID NO: 86805 - protein, 841 aa, Homo sapiens
  Payload ID: 17362
  Gene Symbol: TAS1R1
  Gene Name: taste receptor, type 1, member 1
  Uniprot ID: Q7RTX1
  ENSP ID: ENSP00000331867
MLLCTARLVGLQLLISCCWAFACHSTESSPDFTLPGDYLLAGLFPLHSGCLQVRHRPEVTLCDRSCSFNEHGYHLFQAMRLGVEEINNSTALLPNITLGYQLYDVCSDSANVYATLRVLSLPGQHHIELQGDLLHYSPTVLAVIGPDSTNRAATTAALLSPFLVPMISYAASSETLSVKRQYPSFLRTIPNDKYQVETMVLLLQKFGWTWISLVGSSDDYGQLGVQALENQATGQGICIAFKDIMPFSAQVGDERMQCLMRHLAQAGATVVVVFSSRQLARVFFESVVLTNLTGKVWVASEAWALSRHITGVPGIQRIGMVLGVAIQKRAVPGLKAFEEAYARADKKAPRPCHKGSWCSSNQLCRECQAFMAHTMPKLKAFSMSSAYNAYRAVYAVAHGLHQLLGCASGACSRGRVYPWQLLEQIHKVHFLLHKDTVAFNDNRDPLSSYNIIAWDWNGPKWTFTVLGSSTWSPVQLNINETKIQWHGKDNQVPKSVCSSDCLEGHQRVVTGFHHCCFECVPCGAGTFLNKSDLYRCQPCGKEEWAPEGSQTCFPRTVVFLALREHTSWVLLAANTLLLLLLLGTAGLFAWHLDTPVVRSAGGRLCFLMLGSLAAGSGSLYGFFGEPTRPACLLRQALFALGFTIFLSCLTVRSFQLIIIFKFSTKVPTFYHAWVQNHGAGLFVMISSAAQLLICLTWLVVWTPLPAREYQRFPHLVMLECTETNSLGFILAFLYNGLLSISAFACSYLGKDLPENYNEAKCVTFSLLFNFVSWIAFFTTASVYDGKYLPAANMMAGLSSLSSGFGGYFLPKCYVILCRPDLNSTEHFQASIQDYTRRCGST

SEQ ID NO: 86806 - protein, 247 aa, Homo sapiens
  Payload ID: 17362
  Gene Symbol: TAS1R1
  Gene Name: taste receptor, type 1, member 1
  ENSP ID: ENSP00000408448
  MOD_RES (1)..(1): Any amino acid
XFQAMRLGVEEINNSTALLPNITLGYQLYDVCSDSANVYATLRVLSLPGQHHIELQGDLLHYSPTVLAVIGPDSTNRAATTAALLSPFLVPMLLEQIHKVHFLLHKDTVAFNDNRDPLSSYNIIAWDWNGPKWTFTVLGSSTWSPVQLNINETKIQWHGKDNQVPKSVCSSDCLEGHQRVVTGFHHCCFECVPCGAGTFLNKSATWVRTCQRTTTRPNVSPSACSSTSCPGSPSSPRPASTTASTCL

SEQ ID NO: 86807 - protein, 406 aa, Homo sapiens
  Payload ID: 17362
  Gene Symbol: TAS1R1
  Gene Name: taste receptor, type 1, member 1
  ENSP ID: ENSP00000414166
  MOD_RES (1)..(1): Any amino acid
XFQAMRLGVEEINNSTALLPNITLGYQLYDVCSDSANVYATLRVLSLPGQHHIELQGDLLHYSPTVLAVIGPDSTNRAATTAALLSPFLVPMISYAASSETLSVKRQYPSFLRTIPNDKYQVETMVLLLQKFGWTWISLVGSSDDYGQLGVQALENQATGQGICIAFKDIMPFSAQVGDERMQCLMRHLAQAGATVVVVFSSRQLARVFFESVVLTNLTGKVWVASEAWALSRHITGVPGIQRIGMVLGVAIQKRAVPGLKAFEEAYARADKKAPRPCHKGSWCSSNQLCRECQAFMAHTMPKLKAFSMSSAYNAYRAVYAVAHGLHQLLGCASGACSRGRVYPWQTSTDASLVGKKSGHLREARPASRALWCFWLCVSTPLGCCWQLTRCCCCCCLGLLACLPGT

SEQ ID NO: 86808 - protein, 839 aa, Homo sapiens
  Payload ID: 17363
  Gene Symbol: TAS1R2
  Gene Name: taste receptor, type 1, member 2
  Uniprot ID: Q8TE23
  ENSP ID: ENSP00000364520
MGPRAKTISSLFFLLWVLAEPAENSDFYLPGDYLLGGLFSLHANMKGIVHLNFLQVPMCKEYEVKVIGYNLMQAMRFAVEEINNDSSLLPGVLLGYEIVDVCYISNNVQPVLYFLAHEDNLLPIQEDYSNYISRVVAVIGPDNSESVMTVANFLSLFLLPQITYSAISDELRDKVRFPALLRTTPSADHHIEAMVQLMLHFRWNWIIVLVSSDTYGRDNGQLLGERVARRDICIAFQETLPTLQPNQNMTSEERQRLVTIVDKLQQSTARVVVVFSPDLTLYHFFNEVLRQNFTGAVWIASESWAIDPVLHNLTELRHLGTFLGITIQSVPIPGFSEFREWGPQAGPPPLSRTSQSYTCNQECDNCLNATLSFNTILRLSGERVVYSVYSAVYAVAHALHSLLGCDKSTCTKRVVYPWQLLEEIWKVNFTLLDHQIFFDPQGDVALHLEIVQWQWDRSQNPFQSVASYYPLQRQLKNIQDISWHTINNTIPMSMCSKRCQSGQKKKPVGIHVCCFECIDCLPGTFLNHTEDEYECQACPNNEWSYQSETSCFKRQLVFLEWHEAPTIAVALLAALGFLSTLAILVIFWRHFQTPIVRSAGGPMCFLMLTLLLVAYMVVPVYVGPPKVSTCLCRQALFPLCFTICISCIAVRSFQIVCAFKMASRFPRAYSYWVRYQGPYVSMAFITVLKMVIVVIGMLATGLSPTTRTDPDDPKITIVSCNPNYRNSLLFNTSLDLLLSVVGFSFAYMGKELPTNYNEAKFITLSMTFYFTSSVSLCTFMSAYSGVLVTIVDLLVTVLNLLAISLGYFGPKCYMILFYPERNTPAYFNSMIQGYTMRRD

SEQ ID NO: 86809 - protein, 852 aa, Homo sapiens
  Payload ID: 17364
  Gene Symbol: TAS1R3
  Gene Name: taste receptor, type 1, member 3
  Uniprot ID: Q7RTX0
  ENSP ID: ENSP00000344411
MLGPAVLGLSLWALLHPGTGAPLCLSQQLRMKGDYVLGGLFPLGEAEEAGLRSRTRPSSPVCTRFSSNGLLWALAMKMAVEEINNKSDLLPGLRLGYDLFDTCSEPVVAMKPSLMFLAKAGSRDIAAYCNYTQYQPRVLAVIGPHSSELAMVTGKFFSFFLMPQVSYGASMELLSARETFPSFFRTVPSDRVQLTAAAELLQEFGWNWVAALGSDDEYGRQGLSIFSALAAARGICIAHEGLVPLPRADDSRLGKVQDVLHQVNQSSVQVVLLFASVHAAHALFNYSISSRLSPKVWVASEAWLTSDLVMGLPGMAQMGTVLGFLQRGAQLHEFPQYVKTHLALATDPAFCSALGEREQGLEEDVVGQRCPQCDCITLQNVSAGLNHHQTFSVYAAVYSVAQALHNTLQCNASGCPAQDPVKPWQLLENMYNLTFHVGGLPLRFDSSGNVDMEYDLKLWVWQGSVPRLHDVGRFNGSLRTERLKIRWHTSDNQKPVSRCSRQCQEGQVRRVKGFHSCCYDCVDCEAGSYRQNPDDIACTFCGQDEWSPERSTRCFRRRSRFLAWGEPAVLLLLLLLSLALGLVLAALGLFVHHRDSPLVQASGGPLACFGLVCLGLVCLSVLLFPGQPSPARCLAQQPLSHLPLTGCLSTLFLQAAEIFVESELPLSWADRLSGCLRGPWAWLVVLLAMLVEVALCTWYLVAFPPEVVTDWHMLPTEALVHCRTRSWVSFGLAHATNATLAFLCFLGTFLVRSQPGCYNRARGLTFAMLAYFITWVSFVPLLANVQVVLRPAVQMGALLLCVLGILAAFHLPRCYLLMRQPGLNTPEFFLGGGPGDAQGQNDGNTGNQGKHE

SEQ ID NO: 86810 - protein, 299 aa, Homo sapiens
  Payload ID: 17365
  Gene Symbol: TAS2R1
  Gene Name: taste receptor, type 2, member 1
  Uniprot ID: Q9NYW7
  ENSP ID: ENSP00000371932
MLESHLIIYFLLAVIQFLLGIFTNGIIVVVNGIDLIKHRKMAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 86811 - protein, 61 aa, Homo sapiens
  Payload ID: 17365
  Gene Symbol: TAS2R1
  Gene Name: taste receptor, type 2, member 1
  ENSP ID: ENSP00000475387
MAPLDLLLSCLAVSRIFLQLFIFYVNVIVIFFIEFIMCSANCAILLFINELELWLATWLGV

SEQ ID NO: 86812 - protein, 155 aa, Homo sapiens
  Payload ID: 17365
  Gene Symbol: TAS2R1
  Gene Name: taste receptor, type 2, member 1
  ENSP ID: ENSP00000476190
MAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVL

SEQ ID NO: 86813 - protein, 307 aa, Homo sapiens
  Payload ID: 17366
  Gene Symbol: TAS2R10
  Gene Name: taste receptor, type 2, member 10
  Uniprot ID: Q9NYW0
  ENSP ID: ENSP00000240619
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKTKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 86814 - protein, 307 aa, Homo sapiens; identical to SEQ ID NO: 86813
  Payload ID: 17366
  Gene Symbol: TAS2R10
  Gene Name: taste receptor, type 2, member 10
  Uniprot ID: Q9NYW0
  ENSP ID: ENSP00000461683

SEQ ID NO: 86815 - protein, 307 aa, Homo sapiens; identical to SEQ ID NO: 86813
  Payload ID: 17366
  Gene Symbol: TAS2R10
  Gene Name: taste receptor, type 2, member 10
  Uniprot ID: Q9NYW0
  ENSP ID: ENSP00000482990

SEQ ID NO: 86816 - protein, 303 aa, Homo sapiens
  Payload ID: 17367
  Gene Symbol: TAS2R13
  Gene Name: taste receptor, type 2, member 13
  Uniprot ID: Q9NYV9
  ENSP ID: ENSP00000375095
MESALPSIFTLVIIAEFIIGNLSNGFIVLINCIDWVSKRELSSVDKLLIILAISRIGLIWEILVSWFLALHYLAIFVSGTGLRIMIFSWIVSNHFNLWLATIFSIFYLLKIASFSSPAFLYLKWRVNKVILMILLGTLVFLFLNLIQINMHIKDWLDRYERNTTWNFSMSDFETFSVSVKFTMTMFSLTPFTVAFISFLLLIFSLQKHLQKMQLNYKGHRDPRTKVHTNALKIVISFLLFYASFFLCVLISWISELYQNTVIYMLCETIGVFSPSSHSFLLILGNAKLRQAFLLVAAKVWAKR

SEQ ID NO: 86817 - protein, 303 aa, Homo sapiens; identical to SEQ ID NO: 86816
  Payload ID: 17367
  Gene Symbol: TAS2R13
  Gene Name: taste receptor, type 2, member 13
  Uniprot ID: Q9NYV9
  ENSP ID: ENSP00000461365

SEQ ID NO: 86818 - protein, 303 aa, Homo sapiens; identical to SEQ ID NO: 86816
  Payload ID: 17367
  Gene Symbol: TAS2R13
  Gene Name: taste receptor, type 2, member 13
  Uniprot ID: Q9NYV9
  ENSP ID: ENSP00000478277

SEQ ID NO: 86819 - protein, 317 aa, Homo sapiens
  Payload ID: 17368
  Gene Symbol: TAS2R14
  Gene Name: taste receptor, type 2, member 14
  Uniprot ID: Q9NYV8
  ENSP ID: ENSP00000441949
MGGVIKSIFTFVLIVEFIIGNLGNSFIALVNCIDWVKGRKISSVDRILTALAISRISLVWLIFGSWCVSVFFPALFATEKMFRMLTNIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAMFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 86820 - protein, 317 aa, Homo sapiens; identical to SEQ ID NO: 86819
  Payload ID: 17368
  Gene Symbol: TAS2R14
  Gene Name: taste receptor, type 2, member 14
  Uniprot ID: Q9NYV8
  ENSP ID: ENSP00000458544

SEQ ID NO: 86821 - protein, 317 aa, Homo sapiens; identical to SEQ ID NO: 86819
  Payload ID: 17368
  Gene Symbol: TAS2R14
  Gene Name: taste receptor, type 2, member 14
  Uniprot ID: Q9NYV8
  ENSP ID: ENSP00000484251

SEQ ID NO: 86822 - protein, 291 aa, Homo sapiens
  Payload ID: 17369
  Gene Symbol: TAS2R16
  Gene Name: taste receptor, type 2, member 16
  Uniprot ID: Q9NYV7
  ENSP ID: ENSP00000249284
MIPIQLTVFFMIIYVLESLTIIVQSSLIVAVLGREWLQVRRLMPVDMILISLGISRFCLQWASMLNNFCSYFNLNYVLCNLTITWEFFNILTFWLNSLLTVFYCIKVSSFTHHIFLWLRWRILRLFPWILLGSLMITCVTIIPSAIGNYIQIQLLTMEHLPRNSTVTDKLENFHQYQFQAHTVALVIPFILFLASTIFLMASLTKQIQHHSTGHCNPSMKARFTALRSLAVLFIVFTSYFLTILITIIGTLFDKRCWLWVWEAFVYAFILMHSTSLMLSSPTLKRILKGKC

SEQ ID NO: 86823 - protein, 299 aa, Homo sapiens
  Payload ID: 17370
  Gene Symbol: TAS2R19
  Gene Name: taste receptor, type 2, member 19
  Uniprot ID: P59542
  ENSP ID: ENSP00000375091
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTR

SEQ ID NO: 86824 - protein, 299 aa, Homo sapiens; identical to SEQ ID NO: 86823
  Payload ID: 17370
  Gene Symbol: TAS2R19
  Gene Name: taste receptor, type 2, member 19
  Uniprot ID: P59542
  ENSP ID: ENSP00000461533

SEQ ID NO: 86825 - protein, 319 aa, Homo sapiens
  Payload ID: 17370
  Gene Symbol: TAS2R19
  Gene Name: taste receptor, type 2, member 19
  ENSP ID: ENSP00000479470
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKDRTSQLHRFTRGALCVF

SEQ ID NO: 86826 - protein, 299 aa, Homo sapiens
  Payload ID: 17370
  Gene Symbol: TAS2R19
  Gene Name: taste receptor, type 2, member 19
  ENSP ID: ENSP00000488110
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTC

SEQ ID NO: 86827 - protein, 309 aa, Homo sapiens
  Payload ID: 17371
  Gene Symbol: TAS2R20
  Gene Name: taste receptor, type 2, member 20
  Uniprot ID: P59543
  ENSP ID: ENSP00000441624
MMSFLHIVFSILVVVAFILGNFANGFIALINFIAWVKRQKISSADQIIAALAVSRVGLLWVILLHWYSTVLNPTSSNLKVIIFISNAWAVTNHFSIWLATSLSIFYLLKIVNFSRLIFHHLKRKAKSVVLVIVLGSLFFLVCHLVMKHTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 86828 - protein, 309 aa, Homo sapiens; identical to SEQ ID NO: 86827
  Payload ID: 17371
  Gene Symbol: TAS2R20
  Gene Name: taste receptor, type 2, member 20
  Uniprot ID: P59543
  ENSP ID: ENSP00000459353

SEQ ID NO: 86829 - protein, 309 aa, Homo sapiens
  Payload ID: 17371
  Gene Symbol: TAS2R20
  Gene Name: taste receptor, type 2, member 20
  ENSP ID: ENSP00000488383
MMSFLHIVFSILVVVAFILGNFANGFIALINFIAWVKRQKISSADQIIAALAVSRVGLLWVILLHWYSTVLNPTSSNLEVIIFISNAWAVTNHFSIWLATSLSIFYLLKIVNFSRLIFHHLKRKAKSVVLVIVLGSLFFLVCHLVMKHTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 86830 - protein, 316 aa, Homo sapiens
  Payload ID: 17372
  Gene Symbol: TAS2R3
  Gene Name: taste receptor, type 2, member 3
  Uniprot ID: Q9NYW6
  ENSP ID: ENSP00000247879
MMGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHPTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIGEVMTMFYPAGHSFILILGNSKLKQTFVVMLRCESGHLKPGSKGPIFS

SEQ ID NO: 86831 - protein, 319 aa, Homo sapiens
  Payload ID: 17373
  Gene Symbol: TAS2R30
  Gene Name: taste receptor, type 2, member 30
  Uniprot ID: P59541
  ENSP ID: ENSP00000444736
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLLLCAIYFLSMIISVCNFGRLEKQPVFMFCQAIIFSYPSTHPFILILGNKKLKQIFLSVLRHVRYWVKDRSLRLHRFTRGALCVF

SEQ ID NO: 86832 - protein, 319 aa, Homo sapiens; identical to SEQ ID NO: 86831
  Payload ID: 17373
  Gene Symbol: TAS2R30
  Gene Name: taste receptor, type 2, member 30
  Uniprot ID: P59541
  ENSP ID: ENSP00000458170

SEQ ID NO: 86833 - protein, 308 aa, Homo sapiens
  Payload ID: 17373
  Gene Symbol: TAS2R30
  Gene Name: taste receptor, type 2, member 30
  ENSP ID: ENSP00000478012
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLMLFAIYFLCIITSTWNPRTQQSNLVFLLYQTLAIMYPSFHSFILIMRSRKLKQTSLSVLCQVTCWVKQKPSTP

SEQ ID NO: 86834 - protein, 308 aa, Homo sapiens
  Payload ID: 17373
  Gene Symbol: TAS2R30
  Gene Name: taste receptor, type 2, member 30
  ENSP ID: ENSP00000482280
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLLLFAIYFLCIITSTWNPRTQQSNLVFLLYQTLAIMYPSFHSFILIMRSRKLKQTSLSVLCQVTCWVKQKPSTP

SEQ ID NO: 86835 - protein, 319 aa, Homo sapiens
  Payload ID: 17373
  Gene Symbol: TAS2R30
  Gene Name: taste receptor, type 2, member 30
  ENSP ID: ENSP00000487978
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLLLCAIYFLSMIISVCNLGRLEKQPVFMFCQAIIFSYPSTHPFILILGNKKLKQIFLSVLRHVRYWVKDRSLRLHRFTRGALCVF

SEQ ID NO: 86836 - protein, 309 aa, Homo sapiens
  Payload ID: 17374
  Gene Symbol: TAS2R31
  Gene Name: taste receptor, type 2, member 31
  Uniprot ID: P59538
  ENSP ID: ENSP00000375093
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLICSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 86837 - protein, 309 aa, Homo sapiens; identical to SEQ ID NO: 86836
  Payload ID: 17374
  Gene Symbol: TAS2R31
  Gene Name: taste receptor, type 2, member 31
  Uniprot ID: P59538
  ENSP ID: ENSP00000459810

SEQ ID NO: 86838 - protein, 300 aa, Homo sapiens
  Payload ID: 17374
  Gene Symbol: TAS2R31
  Gene Name: taste receptor, type 2, member 31
  ENSP ID: ENSP00000480480
MITFLPIIFSILIVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLICSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYW

SEQ ID NO: 86839 - protein, 309 aa, Homo sapiens
  Payload ID: 17374
  Gene Symbol: TAS2R31
  Gene Name: taste receptor, type 2, member 31
  ENSP ID: ENSP00000487885
MTTFIPIIFSSVVVVLFVIGNFANGFIALVNSIEWVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNMTWKIKLRSAVYLSDATVTTLGNLVPFTLTLLCFLLLICSLCKHLKKMQLHGKGSQDPSTKVHIKVLQTVIFFLLLCAIYFLSIMISVWSFGSLENKPVFMFCKAIRFSYPSIHPFILIWGNKKLKQTFLSVLRQVRYWVKGEKPSSP

SEQ ID NO: 86840 - protein, 333 aa, Homo sapiens
  Payload ID: 17375
  Gene Symbol: TAS2R38
  Gene Name: taste receptor, type 2, member 38
  Uniprot ID: P59533
  ENSP ID: ENSP00000448219
MLTLTRIRTVSYEVRSTFLFISVLEFAVGFLTNAFVFLVNFWDVVKRQALSNSDCVLLCLSISRLFLHGLLFLSAIQLTHFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQIKDLNLFYSFLFCYLWSVPPFLLFLVSSGMLTVSLGRHMRTMKVYTRNSRDPSLEAHIKALKSLVSFFCFFVISSCAAFISVPLLILWRDKIGVMVCVGIMAACPSGHAAILISGNAKLRRAVMTILLWAQSSLKVRADHKADSRTLC

SEQ ID NO: 86841 - protein, 338 aa, Homo sapiens
  Payload ID: 17376
  Gene Symbol: TAS2R39
  Gene Name: taste receptor, type 2, member 39
  Uniprot ID: P59534
  ENSP ID: ENSP00000405095
MLGRCFPPDTKEKQQLRMTKLCDPAESELSPFLITLILAVLLAEYLIGIIANGFIMAIHAAEWVQNKAVSTSGRILVFLSVSRIALQSLMMLEITISSTSLSFYSEDAVYYAFKISFIFLNFCSLWFAAWLSFFYFVKIANFSYPLFLKLRWRITGLIPWLLWLSVFISFSHSMFCINICTVYCNNSFPIHSSNSTKKTYLSEINVVGLAFFFNLGIVTPLIMFILTATLLILSLKRHTLHMGSNATGSNDPSMEAHMGAIKAISYFLILYIFNAVALFIYLSNMFDINSLWNNLCQIIMAAYPASHSILLIQDNPGLRRAWKRLQLRLHLYPKEWTL

SEQ ID NO: 86842 - protein, 299 aa, Homo sapiens
  Payload ID: 17377
  Gene Symbol: TAS2R4
  Gene Name: taste receptor, type 2, member 4
  Uniprot ID: Q9NYW5
  ENSP ID: ENSP00000247881
MLRLFYFSAIIASVILNFVGIIMNLFITVVNCKTWVKSHRISSSDRILFSLGITRFLMLGLFLVNTIYFVSSNTERSVYLSAFFVLCFMFLDSSSVWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 86843 - protein, 323 aa, Homo sapiens
  Payload ID: 17378
  Gene Symbol: TAS2R40
  Gene Name: taste receptor, type 2, member 40
  Uniprot ID: P59535
  ENSP ID: ENSP00000386210
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDTYSSWNILCKIIMAAYPAGHSVQLILGNPGLRRAWKRFQHQVPLYLKGQTL

SEQ ID NO: 86844 - protein, 307 aa, Homo sapiens
  Payload ID: 17379
  Gene Symbol: TAS2R41
  Gene Name: taste receptor, type 2, member 41
  Uniprot ID: P59536
  ENSP ID: ENSP00000386201
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFPGWVPWLLLGSVLISFIITLLFFWVNYPVYQEFLIRKFSGNMTYKWNTRIETYYFPSLKLVIWSIPFSVFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 86845 - protein, 314 aa, Homo sapiens
  Payload ID: 17380
  Gene Symbol: TAS2R42
  Gene Name: taste receptor, type 2, member 42
  Uniprot ID: Q7RTR8
  ENSP ID: ENSP00000334050
MATELDKIFLILAIAEFIISMLGNVFIGLVNCSEGIKNQKVFSADFILTCLAISTIGQLLVILFDSFLVGLASHLYTTYRLGKTVIMLWHMTNHLTTWLATCLSIFYFFKIAHFPHSLFLWLRWRMNGMIVMLLILSLFLLIFDSLVLEIFIDISLNIIDKSNLTLYLDESKTLYDKLSILKTLLSLTSFIPFSLFLTSLLFLFLSLVRHTRNLKLSSLGSRDSSTEAHRRAMKMVMSFLFLFIVHFFSLQVANWIFFMLWNNKCIKFVMLALNAFPSCHSFILILGNSKLQQTAVRLLWHLRNYTKTPNPLPL

SEQ ID NO: 86846 - protein, 314 aa, Homo sapiens; identical to SEQ ID NO: 86845
  Payload ID: 17380
  Gene Symbol: TAS2R42
  Gene Name: taste receptor, type 2, member 42
  ENSP ID: ENSP00000484611

SEQ ID NO: 86847 - protein, 309 aa, Homo sapiens
  Payload ID: 17381
  Gene Symbol: TAS2R43
  Gene Name: taste receptor, type 2, member 43
  Uniprot ID: P59537
  ENSP ID: ENSP00000431719
MITFLPIIFSSLVVVTFVIGNFANGFIALVNSIEWFKRQKISFADQILTALAVSRVGLLWVLLLNWYSTVLNPAFNSVEVRTTAYNIWAVINHFSNWLATTLSIFYLLKIANFSNFIFLHLKRRVKSVILVMLLGPLLFLACHLFVINMNEIVRTKEFEGNMTWKIKLKSAMYFSNMTVTMVANLVPFTLTLLSFMLLICSLCKHLKKMQLHGKGSQDPSTKVHIKALQTVISFLLLCAIYFLSIMISVWSFGSLENKPVFMFCKAIRFSYPSIHPFILIWGNKKLKQTFLSVFWQMRYWVKGEKTSSP

SEQ ID NO: 86848 - protein, 309 aa, Homo sapiens
  Payload ID: 17381
  Gene Symbol: TAS2R43
  Gene Name: taste receptor, type 2, member 43
  Uniprot ID: P59537
  ENSP ID: ENSP00000458723
MITFLPIIFSSLVVVTFVIGNFANGFIALVNSIESFKRQKISFADQILTALAVSRVGLLWVLLLNWYSTVLNPAFNSVEVRTTAYNIWAVINHFSNWLATTLSIFYLLKIANFSNFIFLHLKRRVKSVILVMLLGPLLFLACHLFVINMNEIVRTKEFEGNMTWKIKLKSAMYFSNMTVTMVANLVPFTLTLLSFMLLICSLCKHLKKMQLRGKGSQDPSTKVHIKALQTVISFLLLCAIYFLSIMISVWSFGSLENKPVFMFCKAIRFSYPSIHPFILIWGNKKLKQTFLSVFWQMRYWVKGEKTSSP

SEQ ID NO: 86849 - protein, 309 aa, Homo sapiens
  Payload ID: 17381
  Gene Symbol: TAS2R43
  Gene Name: taste receptor, type 2, member 43
  ENSP ID: ENSP00000478843
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMNQIVWTKEFEGNMTWKIKLKSAMYFSNMTVTMVANLVPFTLTLLSFMLLICSLCKHLKKMQLRGKGSQDPSTKVHIKALQTVISFLLLCAIYFLSIMISVWSFGSLENKPVFMFCKAIRFSYPSIHPFILIWGNKKLKQTFLSVFWQMRYWVKGEKTSSP

SEQ ID NO: 86850 - protein, 309 aa, Homo sapiens
  Payload ID: 17381
  Gene Symbol: TAS2R43
  Gene Name: taste receptor, type 2, member 43
  ENSP ID: ENSP00000484910
MITFLPIIFSILIVVIFVIGNFANGFIALVNSIEWFKRQKISFADQILTALAVSRVGLLWVLLLNWYSTVLNPAFNSVEVRTTAYNIWAVINHFSNWLATTLSIFYLLKIANFSNFIFLHLKRRVKSVILVMLLGPLLFLACHLFVINMNEIVRTKEFEGNMTWKIKLKSAMYFSNMTVTMVANLVPFTLTLLSFMLLICSLCKHLKKMQLHGKGSQDPSTKVHIKALQTVISFLLLCAIYFLSIMISVWSFGSLENKPVFMFCKAIRFSYPSIHPFILIWGNKKLKQTFLSVFWQMRYWVKGEKTSSP

SEQ ID NO: 86851 - protein, 299 aa, Homo sapiens
  Payload ID: 17381
  Gene Symbol: TAS2R43
  Gene Name: taste receptor, type 2, member 43
  ENSP ID: ENSP00000488357
MITFLPIIFSILVVVTFVIGNFANGFIALVNSTEWVKRQKISFADQIVTALAVSRVGLLWVLLLNWYSTVLNPAFYSVELRTTAYNIWAVTGHFSNWPATSLSIFYLLKIANFSNLIFLRLKRRVKSVILVVLLGPLLFLACHLFVVNMNQIVWTKEYEGNMTWKIKLRRAMYLSDTTVTMLANLVPFTVTLISFLLLVCSLCKHLKKMQLHGKGSQDPSTKVHIKVLQTVISFFLLRAIYFVSVIISVWSFKNLENKPVFMFCQAIGFSCSSAHPFILIWGNKKLKQTYLSVLWQMRY

SEQ ID NO: 86852 - protein, 309 aa, Homo sapiens
  Payload ID: 17382
  Gene Symbol: TAS2R46
  Gene Name: taste receptor, type 2, member 46
  Uniprot ID: P59540
  ENSP ID: ENSP00000436450
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKALQTVTSFLLLCAIYFLSIIMSVWSFESLENKPVFMFCEAIAFSYPSTHPFILIWGNKKLKQTFLSVLWHVRYWVKGEKPSSS

SEQ ID NO: 86853 - protein, 309 aa, Homo sapiens; identical to SEQ ID NO: 86852
  Payload ID: 17382
  Gene Symbol: TAS2R46
  Gene Name: taste receptor, type 2, member 46
  Uniprot ID: P59540
  ENSP ID: ENSP00000460229

SEQ ID NO: 86854 - protein, 310 aa, Homo sapiens
  Payload ID: 17382
  Gene Symbol: TAS2R46
  Gene Name: taste receptor, type 2, member 46
  ENSP ID: ENSP00000481422
MITFLPIIFSSLVVVTFVIGNFANGFIALVNSIESFKRQKISFADQILTALAVSRVGLLWVLLLNWYSTVLNPASFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKALQTVTSFLLLCAIYFLSIIMSVWSFESLENKPVFMFCEAIAFSYPSTHPFILIWGNKKLKQTFLSVLWHVRYWVKGEKPSSS

SEQ ID NO: 86855 - protein, 319 aa, Homo sapiens
  Payload ID: 17382
  Gene Symbol: TAS2R46
  Gene Name: taste receptor, type 2, member 46
  ENSP ID: ENSP00000481837
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKAMQTVTSFLLLCAIYFLSIIISVWSFGSLENKPVFMFCKAIRFSYPSIHPFILIWGNKKLKQTFLSVLRQVRYWVKERSLHLHRFMRGALCVF

SEQ ID NO: 86856 - protein, 308 aa, Homo sapiens
  Payload ID: 17382
  Gene Symbol: TAS2R46
  Gene Name: taste receptor, type 2, member 46
  ENSP ID: ENSP00000482822
MITFLPIIFSILVVVTFVIGNFANGFIALVNSTEWVKRQKISFADQIVTALAVSRVGLLWVLLLNWYSTVLNPAFYSVELRTTAYNIWAVTGHFSNWPATSLSIFYLLKIANFSNLIFLRLKRRVKSVILVVLLGPLLFLACHLFVINMNQIIWTKEYEGNMTWKIKLRSAMYLSNTTVTILANLVPFTLTLISFLLLICSLCKHLKKMQLHGKGSQDPSMKVHIKAMQTVTSFLLLCAIYFLSIIMSVSFESLENKPVFMFCEAIAFSYPSTHPFILIWGNKKLKQTFLSVLWHVRYWVKGEKPSSS

SEQ ID NO: 86857 - protein, 249 aa, Homo sapiens
  Payload ID: 17382
  Gene Symbol: TAS2R46
  Gene Name: taste receptor, type 2, member 46
  ENSP ID: ENSP00000488678
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKAMQTVTSFLLLCAIYFLSIIMSV

SEQ ID NO: 86858 - protein, 299 aa, Homo sapiens
  Payload ID: 17383
  Gene Symbol: TAS2R5
  Gene Name: taste receptor, type 2, member 5
  Uniprot ID: Q9NYW4
  ENSP ID: ENSP00000247883
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 86859 - protein, 299 aa, Homo sapiens
  Payload ID: 17384
  Gene Symbol: TAS2R50
  Gene Name: taste receptor, type 2, member 50
  Uniprot ID: P59544
  ENSP ID: ENSP00000424040
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLCKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 86860 - protein, 299 aa, Homo sapiens; identical to SEQ ID NO: 86859
  Payload ID: 17384
  Gene Symbol: TAS2R50
  Gene Name: taste receptor, type 2, member 50
  Uniprot ID: P59544
  ENSP ID: ENSP00000458551

SEQ ID NO: 86861 - protein, 299 aa, Homo sapiens; identical to SEQ ID NO: 86859
  Payload ID: 17384
  Gene Symbol: TAS2R50
  Gene Name: taste receptor, type 2, member 50
  Uniprot ID: P59544
  ENSP ID: ENSP00000479785

SEQ ID NO: 86862 - protein, 318 aa, Homo sapiens
  Payload ID: 17385
  Gene Symbol: TAS2R60
  Gene Name: taste receptor, type 2, member 60
  Uniprot ID: P59551
  ENSP ID: ENSP00000327724
MNGDHMVLGSSVTDKKAIILVTILLLLRLVAIAGNGFITAALGVEWVLRRMLLPCDKLLVSLGASRFCLQSVVMGKTIYVFLHPMAFPYNPVLQFLAFQWDFLNAATLWSSTWLSVFYCVKIATFTHPVFFWLKHKLSGWLPWMLFSSVGLSSFTTILFFIGNHRMYQNYLRNHLQPWNVTGDSIRSYCEKFYLFPLKMITWTMPTAVFFICMILLITSLGRHRKKALLTTSGFREPSVQAHIKALLALLSFAMLFISYFLSLVFSAAGIFPPLDFKFWVWESVIYLCAAVHPIILLFSNCRLRAVLKSRRSSRCGTP

SEQ ID NO: 86863 - protein, 318 aa, Homo sapiens
  Payload ID: 17386
  Gene Symbol: TAS2R7
  Gene Name: taste receptor, type 2, member 7
  Uniprot ID: Q9NYW3
  ENSP ID: ENSP00000240687
MADKVQTTLLFLAVGEFSVGILGNAFIGLVNCMDWVKKRKIASIDLILTSLAISRICLLCVILLDCFILVLYPDVYATGKEMRIIDFFWTLTNHLSIWFATCLSIYYFFKIGNFFHPLFLWMKWRIDRVISWILLGCVVLSVFISLPATENLNADFRFCVKAKRKTNLTWSCRVNKTQHASTKLFLNLATLLPFCVCLMSFFLLILSLRRHIRRMQLSATGCRDPSTEAHVRALKAVISFLLLFIAYYLSFLIATSSYFMPETELAVIFGESIALIYPSSHSFILILGNNKLRHASLKVIWKVMSILKGRKFQQHKQI

SEQ ID NO: 86864 - protein, 318 aa, Homo sapiens; identical to SEQ ID NO: 86863
  Payload ID: 17386
  Gene Symbol: TAS2R7
  Gene Name: taste receptor, type 2, member 7
  Uniprot ID: Q9NYW3
  ENSP ID: ENSP00000458498

SEQ ID NO: 86865 - protein, 318 aa, Homo sapiens; identical to SEQ ID NO: 86863
  Payload ID: 17386
  Gene Symbol: TAS2R7
  Gene Name: taste receptor, type 2, member 7
  Uniprot ID: Q9NYW3
  ENSP ID: ENSP00000484743

SEQ ID NO: 86866 - protein, 309 aa, Homo sapiens
  Payload ID: 17387
  Gene Symbol: TAS2R8
  Gene Name: taste receptor, type 2, member 8
  Uniprot ID: Q9NYW2
  ENSP ID: ENSP00000240615
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKRNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACMI

SEQ ID NO: 86867 - protein, 309 aa, Homo sapiens; identical to SEQ ID NO: 86866
  Payload ID: 17387
  Gene Symbol: TAS2R8
  Gene Name: taste receptor, type 2, member 8
  Uniprot ID: Q9NYW2
  ENSP ID: ENSP00000461158

SEQ ID NO: 86868 - protein, 309 aa, Homo sapiens; identical to SEQ ID NO: 86866
  Payload ID: 17387
  Gene Symbol: TAS2R8
  Gene Name: taste receptor, type 2, member 8
  Uniprot ID: Q9NYW2
  ENSP ID: ENSP00000484163

SEQ ID NO: 86869 - protein, 312 aa, Homo sapiens
  Payload ID: 17388
  Gene Symbol: TAS2R9
  Gene Name: taste receptor, type 2, member 9
  Uniprot ID: Q9NYW1
  ENSP ID: ENSP00000240691
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKINKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKLREAFLKMLRFVKCFLRRRKPFVP

SEQ ID NO: 86870 - protein, 312 aa, Homo sapiens; identical to SEQ ID NO: 86869
  Payload ID: 17388
  Gene Symbol: TAS2R9
  Gene Name: taste receptor, type 2, member 9
  Uniprot ID: Q9NYW1
  ENSP ID: ENSP00000460247

SEQ ID NO: 86871 - protein, 312 aa, Homo sapiens; identical to SEQ ID NO: 86869
  Payload ID: 17388
  Gene Symbol: TAS2R9
  Gene Name: taste receptor, type 2, member 9
  Uniprot ID: Q9NYW1
  ENSP ID: ENSP00000480069

SEQ ID NO: 86872 - protein, 339 aa, Homo sapiens
  Payload ID: 17389
  Gene Symbol: TBP
  Gene Name: TATA box binding protein
  Uniprot ID: P20226
  ENSP ID: ENSP00000230354
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 86873 - protein, 339 aa, Homo sapiens; identical to SEQ ID NO: 86872
  Payload ID: 17389
  Gene Symbol: TBP
  Gene Name: TATA box binding protein
  Uniprot ID: P20226
  ENSP ID: ENSP00000375942

SEQ ID NO: 86874 - protein, 208 aa, Homo sapiens
  Payload ID: 17389
  Gene Symbol: TBP
  Gene Name: TATA box binding protein
  ENSP ID: ENSP00000400008
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPR

SEQ ID NO: 86875 - protein, 101 aa, Homo sapiens
  Payload ID: 17389
  Gene Symbol: TBP
  Gene Name: TATA box binding protein
  ENSP ID: ENSP00000404905
  MOD_RES (1)..(1): Any amino acid
XEEQSRLAARKYARVVQKLGFPAKFLDFKIQNMVGSCDVKFPISYEPELFPGLIYRMIKPRIVLLIFVSGKVVLTGAKVRAEIYEAFENIYPILKGFRKTT

SEQ ID NO: 86876 - protein, 150 aa, Homo sapiens
  Payload ID: 17389
  Gene Symbol: TBP
  Gene Name: TATA box binding protein
  ENSP ID: ENSP00000416482
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPIT

SEQ ID NO: 86877 - protein, 319 aa, Homo sapiens
  Payload ID: 17389
  Gene Symbol: TBP
  Gene Name: TATA box binding protein
  Uniprot ID: P20226
  ENSP ID: ENSP00000442132
MTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 86878 - protein, 288 aa, Homo sapiens
  Payload ID: 17389
  Gene Symbol: TBP
  Gene Name: TATA box binding protein
  ENSP ID: ENSP00000484118
MDQNNSLPPYAQGLASPQGAMTPGIPIFSPMMPYGTGLTPQPIQNTNSLSILEEQQRQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 86879 - protein, 450 aa, Homo sapiens
  Payload ID: 17390
  Gene Symbol: TAF1A
  Gene Name: TATA box binding protein (TBP)-associated factor, RNA polymerase I, A, 48kDa
  Uniprot ID: Q15573
  ENSP ID: ENSP00000327072
MSDFSEELKGPVTDDEEVETSVLSGAGMHFPWLQTYVETVAIGGKRRKDFAQTTSACLSFIQEALLKHQWQQAAEYMYSYFQTLEDSDSYKRQAAPEIIWKLGSEILFYHPKSNMESFNTFANRMKNIGVMNYLKISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEEHRKLGLEVLFGVLDFAGCTKNITAWKYLAKYLKNILMGNHLAWVQEEWNSRKNWWPGFHFSYFWAKSDWKEDTALACEKAFVAGLLLGKGCRYFRYILKQDHQILGKKIKRMKRSVKKYSIVNPRL

SEQ ID NO: 86880 - protein, 450 aa, Homo sapiens; identical to SEQ ID NO: 86879
  Payload ID: 17390
  Gene Symbol: TAF1A
  Gene Name: TATA box binding protein (TBP)-associated factor, RNA polymerase I, A, 48kDa
  Uniprot ID: Q15573
  ENSP ID: ENSP00000339976

SEQ ID NO: 86881 - protein, 336 aa, Homo sapiens
  Payload ID: 17390
  Gene Symbol: TAF1A
  Gene Name: TATA box binding protein (TBP)-associated factor, RNA polymerase I, A, 48kDa
  Uniprot ID: Q15573
  ENSP ID: ENSP00000355856
MESFNTFANRMKNIGVMNYLKISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEEHRKLGLEVLFGVLDFAGCTKNITAWKYLAKYLKNILMGNHLAWVQEEWNSRKNWWPGFHFSYFWAKSDWKEDTALACEKAFVAGLLLGKGCRYFRYILKQDHQILGKKIKRMKRSVKKYSIVNPRL

SEQ ID NO: 86882 - protein, 286 aa, Homo sapiens
  Payload ID: 17390
  Gene Symbol: TAF1A
  Gene Name: TATA box binding protein (TBP)-associated factor, RNA polymerase I, A, 48kDa
  ENSP ID: ENSP00000375755
MSDFSEELKGPVTDDEEVETSVLSGAGMHFPWLQTYVETVAIGGKRRKDFAQTTSACLSFIQEALLKHQWQQAAEYMYSYFQTLEDSDSYKRQAAPEISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEE

SEQ ID NO: 86883 - protein, 588 aa, Homo sapiens
  Payload ID: 17391
  Gene Symbol: TAF1B
  Gene Name: TATA box binding protein (TBP)-associated factor, RNA polymerase I, B, 63kDa
  Uniprot ID: Q53T94
  ENSP ID: ENSP00000263663
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSETSVCSGSLDGVEYSQRKEKGIVKMTMPQTLAFCYLSLLWQREAITLSDLLRFVEEDHIPYINAFQHFPEQMKLYGRDRGIFGIESWPDYEDIYKKTVEVGTFLDLPRFPDITEDCYLHPNILCMKYLMEVNLPDEMHSLTCHVVKMTGMGEVDFLTFDPIAKMAKTVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 86884 - protein, 57 aa, Homo sapiens
  Payload ID: 17391
  Gene Symbol: TAF1B
  Gene Name: TATA box binding protein (TBP)-associated factor, RNA polymerase I, B, 63kDa
  ENSP ID: ENSP00000402955
MDLEEAEEFKERCTQCAAVSWGLTDEGKYYCTSCHNVTEYLTDYKVFGSIISFPPHH

SEQ ID NO: 86885 - protein, 194 aa, Homo sapiens
  Payload ID: 17391
  Gene Symbol: TAF1B
  Gene Name: TATA box binding protein (TBP)-associated factor, RNA polymerase I, B, 63kDa
  ENSP ID: ENSP00000414184
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSGLLKRTIFLT

SEQ ID NO: 86886 - protein, 216 aa, Homo sapiens
  Payload ID: 17391
  Gene Symbol: TAF1B
  Gene Name: TATA box binding protein (TBP)-associated factor, RNA polymerase I, B, 63kDa
  ENSP ID: ENSP00000475608
  MOD_RES (1)..(1): Any amino acid
XTLSDLLRFVEEDHIPYINAFQHFPEQMKLYGRDRGIFGIESWPDYEDIYKKTVEVGTFLDLPRFPDITEDCYLHPNILCMKYLMEVNLPDEMHSLTCHVVKMTGMGEVDFLTFDPIAKMAKTVKYDVQAVAIIVVVLKLLFLLDDSFEWSLSNLAEKHNEKNKKDKPWFDFRKWYQIMKKAFDEKKQKWEEARAKYVLLPGLDAPALLLCLLLYI

SEQ ID NO: 86887 - protein, 57 aa, Homo sapiens; identical to SEQ ID NO: 86884
  Payload ID: 17391
  Gene Symbol: TAF1B
  Gene Name: TATA box binding protein (TBP)-associated factor, RNA polymerase I, B, 63kDa
  ENSP ID: ENSP00000486572

SEQ ID NO: 86888 - protein, 775 aa, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENSP ID: ENSP00000345305
MLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 86889 - protein, 537 aa, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENSP ID: ENSP00000437900
MQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 86890 - protein, 52 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000454494
MDFPSSLRPALFLTGPLGLSDVPDLSFMCSWRDALTLPEAQPQNSEIPGTLA

SEQ ID NO: 86891 - protein, 146 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000454854
MDFPSSLRPALFLTGPLGLSDVPDLSFMCSWRDALTLPEAQPQNSENGALHVTKDLLWEPATPGPLPMLPPLIDPWDPGLTARDLLFRGGCRYRKRPRVVLDVTEQISRFLLDHGDVAFAPLGKLMLENFKLEGAGSRTKKKTVVS

SEQ ID NO: 86892 - protein, 537 aa, Homo sapiens; identical to SEQ ID NO: 86889
  Payload ID: 17392
  Gene Symbol: TAF1C
  Gene Name: TATA box binding protein (TBP)-associated factor, RNA polymerase I, C, 110kDa
  Uniprot ID: Q15572
  ENSP ID: ENSP00000455247

SEQ ID NO: 86893 - protein, 869 aa, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENSP ID: ENSP00000455265
MDFPSSLRPALFLTGPLGLSDVPDLSFMCSWRDALTLPEAQPQNSENGALHVTKDLLWEPATPGPLPMLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGESKALIYTFLPHWLTCYLTPGPFHPSSALLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 86894 - protein, 58 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000455787
MLENFKLEGAGVSLGLPQQPTAPLLYPRGPHPGHVGGEPLGRAAARGAGAAVGAAASG

SEQ ID NO: 86895 - protein, 843 aa, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENSP ID: ENSP00000455933
MDFPSSLRPALFLTGPLGLSDVPDLSFMCSWRDALTLPEAQPQNSENGALHVTKDLLWEPATPGPLPMLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGETLLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 86896 - protein, 93 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000456011
MLENFKLEGAGSRTKKKTVVSVKKLLQDLGGHQPWGCPWAYLSNRQRRFSILGGPILGTSVASHLAELLHEELVLRWEQLLLDEACTGGALAW

SEQ ID NO: 86897 - protein, 380 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000456101
  MOD_RES (1)..(1): Any amino acid
XSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGLAAVVPPLPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPS

SEQ ID NO: 86898 - protein, 209 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000456133
MDFPSSLRPALFLTGPLGLSDVPDLSFMCSWRDALTLPEAQPQNSENGALHVTKDLLWEPATPGPLPMLPPLIDPWDPGLTARDLLFRGGCRYRKRPRVVLDVTEQISRFLLDHGDVAFAPLGKLMLENFKLEGAGSRTKKKTVVSVKKLLQDLGGHQPWGQVSLGLPQQPTAPLLYPRGPHPGHVGGEPLGRAAARGAGAAVGAAASG

SEQ ID NO: 86899 - protein, 70 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000457281
MLPPLIDPWDPGLTARDLLFRGGCRYRKRPRVVLDVTEQPVPLGSWRRSLCAPGEADAGEFQAGGSGEPH

SEQ ID NO: 86900 - protein, 136 aa, Homo sapiens
  Payload ID: 17392
  Gene Symbol: TAF1C
  Gene Name: TATA box binding protein (TBP)-associated factor, RNA polymerase I, C, 110kDa
  ENSP ID: ENSP00000457883
MDFPSSLRPALFLTGPLGLSDVPDLSFMCSWRDALTLPEAQPQNSENGALHVTKDLLWEPATPGPLPMLPPLIALSVTSFSDPWDPGLTARDLLFRGGCRYRKRPRVVLDVTEQISRFLLDHGDVAFAPLGKLMLE

SEQ ID NO: 86901 - protein, 278 aa, Homo sapiens
  Payload ID: 17393
  Gene Symbol: TAF1D
  Gene Name: TATA box binding protein (TBP)-associated factor, RNA polymerase I, D, 41kDa
  Uniprot ID: Q9H5J8
  ENSP ID: ENSP00000314971
MDKSGIDSLDHVTSDAVELANRSDNSSDSSLFKTQCIPYSPKGEKRNPIRKFVRTPESVHASDSSSDSSFEPIPLTIKAIFERFKNRKKRYKKKKKRRYQPTGRPRGRPEGRRNPIYSLIDKKKQFRSRGSGFPFLESENEKNAPWRKILTFEQAVARGFFNYIEKLKYEHHLKESLKQMNVGEDLENEDFDSRRYKFLDDDGSISPIEESTAEDEDATHLEDNECDIKLAGDSFIVSSEFPVRLSVYLEEEDITEEAALSKKRATKAKNTGQRGLKM

SEQ ID NO: 86902 - protein, 44 aa, Homo sapiens
  Payload ID: 17393
  Gene Symbol: TAF1D
  Gene Name: TATA box binding protein (TBP)-associated factor, RNA polymerase I, D, 41kDa
  ENSP ID: ENSP00000376944
EDATHLEDNECDIKLAGDSFIAFILRTWCLELKVLAYSTHLYHS

SEQ ID NO: 86903 - protein, 278 aa, Homo sapiens; identical to SEQ ID NO: 86901
  Payload ID: 17393
  Gene Symbol: TAF1D
  Gene Name: TATA box binding protein (TBP)-associated factor, RNA polymerase I, D, 41kDa
  Uniprot ID: Q9H5J8
  ENSP ID: ENSP00000410409

SEQ ID NO: 86904 - protein, 110 aa, Homo sapiens
  Payload ID: 17393
  Gene Symbol: TAF1D
  Gene Name: TATA box binding protein (TBP)-associated factor, RNA polymerase I, D, 41kDa
  ENSP ID: ENSP00000431570
  MOD_RES (1)..(1): Any amino acid
XFSSARLEEVGWLSGVGGLRSGGWCVQSSRTPGQSRVLGRGLGYKQQVRGWGHCEAVLVITLLIAAYLKLSVSLTHLKGRKETPFENLFVHLKVFTQVIHQVTHLLNQYH

SEQ ID NO: 86905 - protein, 8 aa, Homo sapiens
  Payload ID: 17393
  Gene Symbol: TAF1D
  Gene Name: TATA box binding protein (TBP)-associated factor, RNA polymerase I, D, 41kDa
  ENSP ID: ENSP00000432852
MDKSGIDS

SEQ ID NO: 86906 - protein, 215 aa, Homo sapiens
  Payload ID: 17393
  Gene Symbol: TAF1D
  Gene Name: TATA box binding protein (TBP)-associated factor, RNA polymerase I, D, 41kDa
  ENSP ID: ENSP00000433119
MDKSGIDSLDHVTSDAVELANRSDNSSDSSLFKTQCIPYSPKGEKRNPIRKFVRTPESVHASDSSSDSSFEPIPLTIKAIFERFKNRKKRYKKKKKRRYQPTGRPRGRPEGRRNPIYSLIDKKKQFRSRGSGFPFLESENEKNAPWRKILTFEQAVARGFFNYIEKLKYEHHLKESLKQMNVGEDLENEDFDSRRYKFLDDDGSISPIEESTLLS

SEQ ID NO: 86907 - protein, 278 aa, Homo sapiens; identical to SEQ ID NO: 86901
  Payload ID: 17393
  Gene Symbol: TAF1D
  Gene Name: TATA box binding protein (TBP)-associated factor, RNA polymerase I, D, 41kDa
  Uniprot ID: Q9H5J8
  ENSP ID: ENSP00000435087

SEQ ID NO: 86908 - protein, 36 aa, Homo sapiens
  Payload ID: 17393
  Gene Symbol: TAF1D
  Gene Name: TATA box binding protein (TBP)-associated factor, RNA polymerase I, D, 41kDa
  ENSP ID: ENSP00000435304
MDKSGIDSLDHVTSDAVELANRRGEKKPHSKICSYT

SEQ ID NO: 86909 - protein, 42 aa, Homo sapiens
  Payload ID: 17393
  Gene Symbol: TAF1D
  Gene Name: TATA box binding protein (TBP)-associated factor, RNA polymerase I, D, 41kDa
  ENSP ID: ENSP00000441633
VSSEFPVRLSVYLEEEDITEEAALSKKRATKAKNTGQRGLKM

SEQ ID NO: 86910 - protein, 26 aa, Homo sapiens
  Payload ID: 17393
  Gene Symbol: TAF1D
  Gene Name: TATA box binding protein (TBP)-associated factor, RNA polymerase I, D, 41kDa
  ENSP ID: ENSP00000446311
  MOD_RES (1)..(1): Any amino acid
XITEEAALSKKRATKAKNTGQRGLKM

SEQ ID NO: 86911 - protein, 375 aa, Homo sapiens
  Payload ID: 17394
  Gene Symbol: TBPL2
  Gene Name: TATA box binding protein like 2
  Uniprot ID: Q6SJ96
  ENSP ID: ENSP00000247219
MASAPWPERVPRLLAPRLPSYPPPPPTVGLRSMEQEETYLELYLDQCAAQDGLAPPRSPLFSPVVPYDMYILNASNPDTAFNSNPEVKETSGDFSSVDLSFLPDEVTQENKDQPVISKHETEENSESQSPQSRLPSPSEQDVGLGLNSSSLSNSHSQLHPGDTDSVQPSPEKPNSDSLSLASITPMTPMTPISECCGIVPQLQNIVSTVNLACKLDLKKIALHAKNAEYNPKRFAAVIMRIREPRTTALIFSSGKMVCTGAKSEEQSRLAARKYARVVQKLGFPARFLDFKIQNMVGSCDVRFPIRLEGLVLTHQQFSSYEPELFPGLIYRMVKPRIVLLIFVSGKVVLTGAKERSEIYEAFENIYPILKGFKKA

SEQ ID NO: 86912 - protein, 22 aa, Homo sapiens
  Payload ID: 17394
  Gene Symbol: TBPL2
  Gene Name: TATA box binding protein like 2
  ENSP ID: ENSP00000451597
MYILNASNPDTAFNSNPEVKET

SEQ ID NO: 86913 - protein, 1093 aa, Homo sapiens
  Payload ID: 17395
  Gene Symbol: TMF1
  Gene Name: TATA element modulatory factor 1
  Uniprot ID: P82094
  ENSP ID: ENSP00000381567
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 86914 - protein, 775 aa, Homo sapiens
  Payload ID: 17395
  Gene Symbol: TMF1
  Gene Name: TATA element modulatory factor 1
  ENSP ID: ENSP00000419330
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQLRENVQLQKNSLLTKFRCLPWSHRILF

SEQ ID NO: 86915 - protein, 1092 aa, Homo sapiens
  Payload ID: 17395
  Gene Symbol: TMF1
  Gene Name: TATA element modulatory factor 1
  ENSP ID: ENSP00000438706
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGRIKHIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 86916 - protein, 297 aa, Homo sapiens
  Payload ID: 17396
  Gene Symbol: TATDN1
  Gene Name: TatD DNase domain containing 1
  Uniprot ID: Q6P1N9
  ENSP ID: ENSP00000276692
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 86917 - protein, 93 aa, Homo sapiens
  Payload ID: 17396
  Gene Symbol: TATDN1
  Gene Name: TatD DNase domain containing 1
  ENSP ID: ENSP00000427807
MSRFKFIGMFFSTVGCHPTRCGEFEKNNPDLYLKELLNLAENNKGKVVAIGECGLDFDRLQFCPKDTQLKYFEKQFELSEQTKLPMFLHCRNS

SEQ ID NO: 86918 - protein, 110 aa, Homo sapiens
  Payload ID: 17396
  Gene Symbol: TATDN1
  Gene Name: TatD DNase domain containing 1
  ENSP ID: ENSP00000428109
MITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEF

SEQ ID NO: 86919 - protein, 250 aa, Homo sapiens
  Payload ID: 17396
  Gene Symbol: TATDN1
  Gene Name: TatD DNase domain containing 1
  Uniprot ID: Q6P1N9
  ENSP ID: ENSP00000428336
MITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 86920 - protein, 40 aa, Homo sapiens
  Payload ID: 17396
  Gene Symbol: TATDN1
  Gene Name: TatD DNase domain containing 1
  ENSP ID: ENSP00000428580
MSRFKFIDIGINLTDPMFRGIYRGVQKHQVYDYRWKSTRQ

SEQ ID NO: 86921 - protein, 207 aa, Homo sapiens
  Payload ID: 17396
  Gene Symbol: TATDN1
  Gene Name: TatD DNase domain containing 1
  ENSP ID: ENSP00000428609
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCIMYTYTRHI

SEQ ID NO: 86922 - protein, 56 aa, Homo sapiens
  Payload ID: 17396
  Gene Symbol: TATDN1
  Gene Name: TatD DNase domain containing 1
  ENSP ID: ENSP00000429541
MSRFKFIDDLQDVIGRAVEIGVKKFMITGGNLQDSKDALHLAQTNGILIFLLPKKK

SEQ ID NO: 86923 - protein, 40 aa, Homo sapiens; identical to SEQ ID NO: 86920
  Payload ID: 17396
  Gene Symbol: TATDN1
  Gene Name: TatD DNase domain containing 1
  ENSP ID: ENSP00000429831

SEQ ID NO: 86924 - protein, 210 aa, Homo sapiens
  Payload ID: 17396
  Gene Symbol: TATDN1
  Gene Name: TatD DNase domain containing 1
  ENSP ID: ENSP00000430201
MFRGIYRGVQKHQGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIM

SEQ ID NO: 86925 - protein, 322 aa, Homo sapiens
  Payload ID: 17396
  Gene Symbol: TATDN1
  Gene Name: TatD DNase domain containing 1
  ENSP ID: ENSP00000430274
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNALCIHIHVISDYGRTVYSVTVIHLCSQRNRGSKKLGNSSLKTEANLEVLKSIPSEKLMIETDAPWCGVKSTHAGSKYIRTAFPTKKKWESGHCLKDRNEPCHIIQILEIMSAVRDEDPLELANTLY

SEQ ID NO: 86926 - protein, 202 aa, Homo sapiens
  Payload ID: 17396
  Gene Symbol: TATDN1
  Gene Name: TatD DNase domain containing 1
  ENSP ID: ENSP00000430481
  MOD_RES (1)..(1): Any amino acid
XSSLSVRGAFSTPLGLSDLSRASVTKVTGPRNCALRHYIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGV

SEQ ID NO: 86927 - protein, 62 aa, Homo sapiens
  Payload ID: 17396
  Gene Symbol: TATDN1
  Gene Name: TatD DNase domain containing 1
  ENSP ID: ENSP00000430756
MFRGIYRGVQKHQDDLQDVIGRAVEIGVKKFMITGGNLQDSKDALHLAQTNGILIFLLPKKK

SEQ ID NO: 86928 - protein, 75 aa, Homo sapiens
  Payload ID: 17396
  Gene Symbol: TATDN1
  Gene Name: TatD DNase domain containing 1
  ENSP ID: ENSP00000431052
MSRFKFIDDLQDVIGRAVEIGVKKFMITGGNLQDSKDALHLAQTNDILKNSLNCQNKQNYQCFFIVETHMLNFWT

SEQ ID NO: 86929 - protein, 210 aa, Homo sapiens
  Payload ID: 17396
  Gene Symbol: TATDN1
  Gene Name: TatD DNase domain containing 1
  ENSP ID: ENSP00000476180
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGWYVLRLLWFLTFI

SEQ ID NO: 86930 - protein, 243 aa, Homo sapiens
  Payload ID: 17396
  Gene Symbol: TATDN1
  Gene Name: TatD DNase domain containing 1
  ENSP ID: ENSP00000487380
MFRGIYRGVQKHQGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 86931 - protein, 761 aa, Homo sapiens
  Payload ID: 17397
  Gene Symbol: TATDN2
  Gene Name: TatD DNase domain containing 2
  Uniprot ID: Q93075
  ENSP ID: ENSP00000287652
MASERGKVKHNWSSTSEGCPRKRSCLREPCDVAPSSRPAQRSASRSGGPSSPKRLKAQKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKRKRDRLRDQGSTMIYLKAIQGILGKSMPKRKGEAATRAKPSAAEHPSHGEGPARSEGPAKTAEGAARSVTVTAAQKEKDATPEVSMEEDKTVPERSSFYDRRVVIDPQEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCDPRTLTDCLWEELLKEDLVWGAFGCHPHFARYYSESQERNLLQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQVPKSLCQYAHPGLALHTVREIARVKDQPLSLTLAALRENTSRLYSL

SEQ ID NO: 86932 - protein, 182 aa, Homo sapiens
  Payload ID: 17397
  Gene Symbol: TATDN2
  Gene Name: TatD DNase domain containing 2
  ENSP ID: ENSP00000389896
LQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQVPKSLCQYAHPGLALHTVREIARVKDQPLSLTLAALRENTSRLYSL

SEQ ID NO: 86933 - protein, 761 aa, Homo sapiens; identical to SEQ ID NO: 86931
  Payload ID: 17397
  Gene Symbol: TATDN2
  Gene Name: TatD DNase domain containing 2
  Uniprot ID: Q93075
  ENSP ID: ENSP00000408736

SEQ ID NO: 86934 - protein, 273 aa, Homo sapiens
  Payload ID: 17398
  Gene Symbol: TATDN3
  Gene Name: TatD DNase domain containing 3
  Uniprot ID: Q17R31
  ENSP ID: ENSP00000355940
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQQKLVKQLPLTSICLETDSPALGPEKQVRNEPWNISISAEYIAQVKGISVEEVIEVTTQNALKLFPKLRHLLQK

SEQ ID NO: 86935 - protein, 274 aa, Homo sapiens
  Payload ID: 17398
  Gene Symbol: TATDN3
  Gene Name: TatD DNase domain containing 3
  Uniprot ID: Q17R31
  ENSP ID: ENSP00000355941
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQKQKLVKQLPLTSICLETDSPALGPEKQVRNEPWNISISAEYIAQVKGISVEEVIEVTTQNALKLFPKLRHLLQK

SEQ ID NO: 86936 - protein, 281 aa, Homo sapiens
  Payload ID: 17398
  Gene Symbol: TATDN3
  Gene Name: TatD DNase domain containing 3
  Uniprot ID: Q17R31
  ENSP ID: ENSP00000431376
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQLLSLFSKKQKLVKQLPLTSICLETDSPALGPEKQVRNEPWNISISAEYIAQVKGISVEEVIEVTTQNALKLFPKLRHLLQK

SEQ ID NO: 86937 - protein, 144 aa, Homo sapiens
  Payload ID: 17398
  Gene Symbol: TATDN3
  Gene Name: TatD DNase domain containing 3
  ENSP ID: ENSP00000431379
  MOD_RES (1)..(1): Any amino acid
XRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPV

SEQ ID NO: 86938 - protein, 41 aa, Homo sapiens
  Payload ID: 17398
  Gene Symbol: TATDN3
  Gene Name: TatD DNase domain containing 3
  ENSP ID: ENSP00000432006
  MOD_RES (1)..(1): Any amino acid
XRPTINLLQEQEAETCETIAFNFYMLRNRFTCTRTRKTGTE

SEQ ID NO: 86939 - protein, 61 aa, Homo sapiens
  Payload ID: 17398
  Gene Symbol: TATDN3
  Gene Name: TatD DNase domain containing 3
  ENSP ID: ENSP00000432730
MRAAGVGLVDCHCHLSAPDFDRDLDDVLEKAKKANVVALVAVAEHSGEFEKIMQLSERIWM

SEQ ID NO: 86940 - protein, 60 aa, Homo sapiens
  Payload ID: 17398
  Gene Symbol: TATDN3
  Gene Name: TatD DNase domain containing 3
  ENSP ID: ENSP00000433143
  MOD_RES (1)..(1): Any amino acid
XAAGVGLVDCHCHLSAPDFDRDLDDVLEKAKKANVVALVAVAEHSGEFEKIMQLSERIWM

SEQ ID NO: 86941 - protein, 240 aa, Homo sapiens
  Payload ID: 17398
  Gene Symbol: TATDN3
  Gene Name: TatD DNase domain containing 3
  Uniprot ID: Q17R31
  ENSP ID: ENSP00000433755
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQLLSLFSKKQKLVKQLPLTSICLETDSPALGPEKQQNILPR

SEQ ID NO: 86942 - protein, 161 aa, Homo sapiens
  Payload ID: 17398
  Gene Symbol: TATDN3
  Gene Name: TatD DNase domain containing 3
  ENSP ID: ENSP00000434276
MREWYCRSEGWKAFQEGRSKQDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQ

SEQ ID NO: 86943 - protein, 101 aa, Homo sapiens
  Payload ID: 17398
  Gene Symbol: TATDN3
  Gene Name: TatD DNase domain containing 3
  ENSP ID: ENSP00000434428
MRAAGVGLVDCHCHLSAPDFDRDLDDVLEKAKKANVVALVAVAEHSGEFEKIMQLSERYNGFVLPCLGVHPVQGLPPEDQRSVTLKVLRRYCCMHLMVGHL

SEQ ID NO: 86944 - protein, 253 aa, Homo sapiens
  Payload ID: 17398
  Gene Symbol: TATDN3
  Gene Name: TatD DNase domain containing 3
  Uniprot ID: Q17R31
  ENSP ID: ENSP00000434801
MRAAGVGLVDCHCHLSAPDFDRDLDDVLEKAKKANVVALVAVAEHSGEFEKIMQLSERYNGFVLPCLGVHPVQGLPPEDQRSVTLKVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQKQKLVKQLPLTSICLETDSPALGPEKQVRNEPWNISISAEYIAQVKGISVEEVIEVTTQNALKLFPKLRHLLQK

SEQ ID NO: 86945 - protein, 191 aa, Homo sapiens
  Payload ID: 17398
  Gene Symbol: TATDN3
  Gene Name: TatD DNase domain containing 3
  ENSP ID: ENSP00000436364
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQAETCETIAFNFYMLRNRFTCTRTRKTGTE

SEQ ID NO: 86946 - protein, 31 aa, Homo sapiens
  Payload ID: 17398
  Gene Symbol: TATDN3
  Gene Name: TatD DNase domain containing 3
  ENSP ID: ENSP00000475492
  MOD_RES (1)..(1): Any amino acid
XCLGVHPVQGLPPEDQRSVTLKVTVIQNRNH

SEQ ID NO: 86947 - protein, 1321 aa, Homo sapiens
  Payload ID: 17399
  Gene Symbol: TTBK1
  Gene Name: tau tubulin kinase 1
  Uniprot ID: Q5TCY1
  ENSP ID: ENSP00000259750
MQCLAAALKDETNMSGGGEQADILPANYVVKDRWKVLKKIGGGGFGEIYEAMDLLTRENVALKVESAQQPKQVLKMEVAVLKKLQGKDHVCRFIGCGRNEKFNYVVMQLQGRNLADLRRSQPRGTFTLSTTLRLGKQILESIEAIHSVGFLHRDIKPSNFAMGRLPSTYRKCYMLDFGLARQYTNTTGDVRPPRNVAGFRGTVRYASVNAHKNREMGRHDDLWSLFYMLVEFAVGQLPWRKIKDKEQVGMIKEKYEHRMLLKHMPSEFHLFLDHIASLDYFTKPDYQLIMSVFENSMKERGIAENEAFDWEKAGTDALLSTSTSTPPQQNTRQTAAMFGVVNVTPVPGDLLRENTEDVLQGEHLSDQENAPPILPGRPSEGLGPSPHLVPHPGGPEAEVWEETDVNRNKLRINIGKSPCVEEEQSRGMGVPSSPVRAPPDSPTTPVRSLRYRRVNSPESERLSTADGRVELPERRSRMDLPGSPSRQACSSQPAQMLSVDTGHADRQASGRMDVSASVEQEALSNAFRSVPLAEEEDFDSKEWVIIDKETELKDFPPGAEPSTSGTTDEEPEELRPLPEEGEERRRLGAEPTVRPRGRSMQALAEEDLQHLPPQPLPPQLSQGDGRSETSQPPTPGSPSHSPLHSGPRPRRRESDPTGPQRQVFSVAPPFEVNGLPRAVPLSLPYQDFKRDLSDYRERARLLNRVRRVGFSHMLLTTPQVPLAPVQPQANGKEEEEEEEEDEEEEEEDEEEEEEEEEEEEEEEEEEEEEEEAAAAVALGEVLGPRSGSSSEGSERSTDRSQEGAPSTLLADDQKESRGRASMADGDLEPEEGSKTLVLVSPGDMKKSPVTAELAPDPDLGTLAALTPQHERPQPTGSQLDVSEPGTLSSVLKSEPKPPGPGAGLGAGTVTTGVGGVAVTSSPFTKVERTFVHIAEKTHLNVMSSGGQALRSEEFSAGGELGLELASDGGAVEEGARAPLENGLALSGLNGAEIEGSALSGAPRETPSEMATNSLPNGPALADGPAPVSPLEPSPEKVATISPRRHAMPGSRPRSRIPVLLSEEDTGSEPSGSLSAKERWSKRARPQQDLARLVMEKRQGRLLLRLASGASSSSSEEQRRASETLSGTGSEEDTPASEPAAALPRKSGRAAATRSRIPRPIGLRMPMPVAAQQPASRSHGAAPALDTAITSRLQLQTPPGSATAADLRPKQPPGRGLGPGRAQAGARPPAPRSPRLPASTSAARNASASPRSQSLSRRESPSPSHQARPGVPPPRGVPPARAQPDGTPSPGGSKKGPRGKLQAQRATTKGRAGGAEGRAGAR

SEQ ID NO: 86948 - protein, 668 aa, Homo sapiens
  Payload ID: 17399
  Gene Symbol: TTBK1
  Gene Name: tau tubulin kinase 1
  ENSP ID: ENSP00000307357
MDLLTRENVALKVESAQQPKQVLKMEVAVLKKLQGKDHVCRFIGCGRNEKFNYVVMQLQGRNLADLRRSQPRGTFTLSTTLRLGKQILESIEAIHSVGFLHRDIKPSNFAMGRLPSTYRKCYMLDFGLARQYTNTTGDVRPPRNVAGFRGTVRYASVNAHKNREMGRHDDLWSLFYMLVEFAVGQLPWRKIKDKEQVGMIKEKYEHRMLLKHMPSEFHLFLDHIASLDYFTKPDYQLIMSVFENSMKERGIAENEAFDWEKAGTDALLSTSTSTPPQQNTRQTAAMFGVVNVTPVPGDLLRENTEDVLQGEHLSDQENAPPILPGRPSEGLGPSPHLVPHPGGPEAEVWEETDVNRNKLRINIGKSPCVEEEQSRGMGVPSSPVRAPPDSPTTPVRSLRYRRVNSPESERLSTADGRVELPERRSRMDLPGSPSRQACSSQPAQMLSVDTGHADRQASGRMDVSASVEQEALSNAFRSVPLAEEEDFDSKEWVIIDKETELKDFPPGAEPSTSGTTDEEPEELRPLPEEGEERRRLGAEPTVRPRGRSMQALAEEDLQHLPPQPLPPQLSQGDGRSETSQPPTPGSPSHSPLHSGPRPRRRESDPTGPQRQLEEDRLSGHSLPRYSPLRRLASSVFSSSTLETEHYPHPGGGGSSGSSGSLIQRSRSA

SEQ ID NO: 86949 - protein, 1244 aa, Homo sapiens
  Payload ID: 17400
  Gene Symbol: TTBK2
  Gene Name: tau tubulin kinase 2
  Uniprot ID: Q6IQ55
  ENSP ID: ENSP00000267890
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 86950 - protein, 84 aa, Homo sapiens
  Payload ID: 17400
  Gene Symbol: TTBK2
  Gene Name: tau tubulin kinase 2
  ENSP ID: ENSP00000454605
MSGGGEQLDILSVGILVKERWKVGKTMFVDLLAVGGMIDSTMWSCSCRVGIWQIFAVASPEAHSPLVPLSGWVDRFWSLLKAFI

SEQ ID NO: 86951 - protein, 117 aa, Homo sapiens
  Payload ID: 17400
  Gene Symbol: TTBK2
  Gene Name: tau tubulin kinase 2
  ENSP ID: ENSP00000455574
MSGGGEQLDILSVGILVKERWKVGKCCTEGGISSTTKTSSENGSCCFEKAARVGIWQIFAVASPEAHSPLVPLSGWVDRFWSLLKAFILWDSCIETSNRRTSLWVAFLVHVGNVTCL

SEQ ID NO: 86952 - protein, 478 aa, Homo sapiens
  Payload ID: 17400
  Gene Symbol: TTBK2
  Gene Name: tau tubulin kinase 2
  Uniprot ID: Q6IQ55
  ENSP ID: ENSP00000455734
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETWYKIVYFSF

SEQ ID NO: 86953 - protein, 143 aa, Homo sapiens
  Payload ID: 17400
  Gene Symbol: TTBK2
  Gene Name: tau tubulin kinase 2
  ENSP ID: ENSP00000457385
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIK

SEQ ID NO: 86954 - protein, 443 aa, Homo sapiens
  Payload ID: 17400
  Gene Symbol: TTBK2
  Gene Name: tau tubulin kinase 2
  ENSP ID: ENSP00000457489
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETWYKIVYFSF

SEQ ID NO: 86955 - protein, 1649 aa, Homo sapiens
  Payload ID: 17400
  Gene Symbol: TTBK2
  Gene Name: tau tubulin kinase 2
  ENSP ID: ENSP00000479984
MESVEKDWGWGLWRNLRCLGHAHQGKCCTEGGISSTTKTSSENGSCCFEKAARKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQMSIRVTRKSYKVSTSGPQAFNSLSYTSGPGACISSSSFSRMGSSSFRGGLGAGYGGASGGITTITVNQSLLSPLNLEVDPNIQAVRTQEEKQIKTLNNKFFSFIDKVRFLEQQNKMLETKWSLVQQQKMARSNMDNMFESYINNLKWQLETLGQEKLKLEAELGNMHGLVEDFRNKYEVEISKCTEMENEFVLIKEYVDEAYMNKMELESSLKELTAKISFLRQLYEEEIGSCSPRSRIHLWCCSWTTAASWTWTASSLRSRPEGFPGGCHADTEQRGELAIKDANAKLSELEAALQLASQDMARQLREYQELMNVKLALDIKIATYRKLLEGEESWLESGMQNMSIHMKTTSSYAGGQSLAYGGLTSPGLSYGLGSSFGSGMGSSSFSHTSSSRAVVMKKIETRDGKLVSESSNVLPNLRITATLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 86956 - protein, 747 aa, Homo sapiens
  Payload ID: 17401
  Gene Symbol: TAX1BP1
  Gene Name: Tax1 (human T-cell leukemia virus type I) binding protein 1
  Uniprot ID: Q86VP1
  ENSP ID: ENSP00000265393
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 86957 - protein, 789 aa, Homo sapiens
  Payload ID: 17401
  Gene Symbol: TAX1BP1
  Gene Name: Tax1 (human T-cell leukemia virus type I) binding protein 1
  Uniprot ID: Q86VP1
  ENSP ID: ENSP00000379612
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 86958 - protein, 813 aa, Homo sapiens
  Payload ID: 17401
  Gene Symbol: TAX1BP1
  Gene Name: Tax1 (human T-cell leukemia virus type I) binding protein 1
  ENSP ID: ENSP00000386515
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKLQLAEKDKEISGLISHLENLSREKELKRSLENPAERKMEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 86959 - protein, 91 aa, Homo sapiens
  Payload ID: 17401
  Gene Symbol: TAX1BP1
  Gene Name: Tax1 (human T-cell leukemia virus type I) binding protein 1
  ENSP ID: ENSP00000391215
MTSFQEVPLQTSNFAHVIFQNVAKSYLPNAHLECHYTLTPYIHPHPKDWVGIFKVGWSTARDYYTFLWSPMPEHYVEGSTVNCVLAFQVEN

SEQ ID NO: 86960 - protein, 590 aa, Homo sapiens
  Payload ID: 17401
  Gene Symbol: TAX1BP1
  Gene Name: Tax1 (human T-cell leukemia virus type I) binding protein 1
  Uniprot ID: Q86VP1
  ENSP ID: ENSP00000391907
MKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 86961 - protein, 98 aa, Homo sapiens
  Payload ID: 17401
  Gene Symbol: TAX1BP1
  Gene Name: Tax1 (human T-cell leukemia virus type I) binding protein 1
  ENSP ID: ENSP00000395290
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGE

SEQ ID NO: 86962 - protein, 138 aa, Homo sapiens
  Payload ID: 17401
  Gene Symbol: TAX1BP1
  Gene Name: Tax1 (human T-cell leukemia virus type I) binding protein 1
  ENSP ID: ENSP00000411490
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNS

SEQ ID NO: 86963 - protein, 326 aa, Homo sapiens
  Payload ID: 17401
  Gene Symbol: TAX1BP1
  Gene Name: Tax1 (human T-cell leukemia virus type I) binding protein 1
  ENSP ID: ENSP00000412575
ADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKLQLAEKDKEISGLISHLENLSREKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 86964 - protein, 747 aa, Homo sapiens; identical to SEQ ID NO: 86956
  Payload ID: 17401
  Gene Symbol: TAX1BP1
  Gene Name: Tax1 (human T-cell leukemia virus type I) binding protein 1
  Uniprot ID: Q86VP1
  ENSP ID: ENSP00000444811

SEQ ID NO: 86965 - protein, 142 aa, Homo sapiens
  Payload ID: 17401
  Gene Symbol: TAX1BP1
  Gene Name: Tax1 (human T-cell leukemia virus type I) binding protein 1
  ENSP ID: ENSP00000477282
GFCFDSSFDVHKKCPLCELMFPPNYDQSKFEEHVESHWKVCPMCSEQFPPDYDQQVFERNWAGKRLLFPSIHAHGAEDGFGADGTLCGPGLIAVRLLIVHLLLVILAACRTREVQGLSGALISPQVHPATSRTGDVAVAEQR

SEQ ID NO: 86966 - protein, 124 aa, Homo sapiens
  Payload ID: 17402
  Gene Symbol: TAX1BP3
  Gene Name: Tax1 (human T-cell leukemia virus type I) binding protein 3
  Uniprot ID: O14907
  ENSP ID: ENSP00000225525
MSYIPGQPVTAVVQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 86967 - protein, 98 aa, Homo sapiens
  Payload ID: 17402
  Gene Symbol: TAX1BP3
  Gene Name: Tax1 (human T-cell leukemia virus type I) binding protein 3
  ENSP ID: ENSP00000484776
MSYIPGQPVTAVVQRVEIHKLRQGENLILGFSIGGGIDQDPSQNPFSEDKTDKVNGWDMTMVTHDQARKRLTKRSEEVVRLLVTRQSLQKAVQQSMLS

SEQ ID NO: 86968 - protein, 546 aa, Homo sapiens
  Payload ID: 17403
  Gene Symbol: TXLNA
  Gene Name: taxilin alpha
  Uniprot ID: P40222
  ENSP ID: ENSP00000362711
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 86969 - protein, 546 aa, Homo sapiens; identical to SEQ ID NO: 86968
  Payload ID: 17403
  Gene Symbol: TXLNA
  Gene Name: taxilin alpha
  Uniprot ID: P40222
  ENSP ID: ENSP00000362712

SEQ ID NO: 86970 - protein, 684 aa, Homo sapiens
  Payload ID: 17404
  Gene Symbol: TXLNB
  Gene Name: taxilin beta
  Uniprot ID: Q8N3L3
  ENSP ID: ENSP00000351206
MEANHSEQLSAERQSTPPGDSSSLPSHNGLEKEDGQDSPTPVQPPEKEASVHPDISEELNRQLEDIINTYGSAASTAGKEGSARASEQPENAESPDNEDGDCEETTEEAGREPVASGEPPTVKEPVSNKEQKLEKKILKGLGKEANLLMQNLNKLQTPEEKFDFLFKKYAELLDEHRTEQKKLKLLQKKQVQIQKEKDQLQGEHSRAILARSKLESLCRELQRHNKTLKEEALQRAREEEEKRKEITSHFQSTLTDIQGQIEQQSERNMKLCQENTELAEKLKSIIDQYELREEHLDKIFKHRELQQKLVDAKLEQAQEMMKEAEERHKREKEYLLNQAAEWKLQAKVLKEQETVLQAQLTLYSGRFEEFQSTLTKSNEVFATFKQEMDKTTKKMKKLEKDTATWKARFENCNKALLDMIEEKALRAKEYECFVMKIGRLENLCRALQEERNELHKKIRDAEISEKDDQSQHNSDEEPESNVSVDQEIDAEEVNSVQTAVKNLATAFMIIHHPESTPHQSKETQPEIGSSQESADAALKEPEQPPLIPSRDSESPLPPLTPQAEAEGGSDAEPPSKASNSPAGLGAETQCEGLPVGAQADQASWKPEAEASGQAPQAPTEASLQKMEADVPAPACAAEEHVAAMVPACEPSRQPPRAAAEELPVGASAGPQPRNVADTNLEGVD

SEQ ID NO: 86971 - protein, 133 aa, Homo sapiens
  Payload ID: 17404
  Gene Symbol: TXLNB
  Gene Name: taxilin beta
  ENSP ID: ENSP00000356624
  MOD_RES (1)..(1): Any amino acid
XYELREEHLDKIFKHRELQQKLVDAKLEQAQEMMKEAEERHKREKEYLLNQAAEWKLQAKVLKEQETVLQAQVRPGGRGMGVLSSLSPDKKAGAKGGQQKSSYVAGDGGMGIGNEEQLHIYSYFQVKIKAQYY

SEQ ID NO: 86972 - protein, 528 aa, Homo sapiens
  Payload ID: 17405
  Gene Symbol: TXLNG
  Gene Name: taxilin gamma
  Uniprot ID: Q9NUQ3
  ENSP ID: ENSP00000369465
MATRVEEAARGRGGGAEEATEAGRGGRRRSPRQKFEIGTMEEAGICGLGVKADMLCNSQSNDILQHQGSNCGGTSNKHSLEEDEGSDFITENRNLVSPAYCTQESREEIPGGEARTDPPDGQQDSECNRNKEKTLGKEVLLLMQALNTLSTPEEKLAALCKKYADLLEESRSVQKQMKILQKKQAQIVKEKVHLQSEHSKAILARSKLESLCRELQRHNKTLKEENMQQAREEEERRKEATAHFQITLNEIQAQLEQHDIHNAKLRQENIELGEKLKKLIEQYALREEHIDKVFKHKELQQQLVDAKLQQTTQLIKEADEKHQREREFLLKEATESRHKYEQMKQQEVQLKQQLSLYMDKFEEFQTTMAKSNELFTTFRQEMEKMTKKIKKLEKETIIWRTKWENNNKALLQMAEEKTVRDKEYKALQIKLERLEKLCRALQTERNELNEKVEVLKEQVSIKAAIKAANRDLATPVMQPCTALDSHKELNTSSKRALGAHLEAEPKSQRSAVQKPPSTGSAPAIESVD

SEQ ID NO: 86973 - protein, 396 aa, Homo sapiens
  Payload ID: 17405
  Gene Symbol: TXLNG
  Gene Name: taxilin gamma
  Uniprot ID: Q9NUQ3
  ENSP ID: ENSP00000381222
MATRVEEAARGRGGGAEEATEAGRGGRRRSPRQKLEESRSVQKQMKILQKKQAQIVKEKVHLQSEHSKAILARSKLESLCRELQRHNKTLKEENMQQAREEEERRKEATAHFQITLNEIQAQLEQHDIHNAKLRQENIELGEKLKKLIEQYALREEHIDKVFKHKELQQQLVDAKLQQTTQLIKEADEKHQREREFLLKEATESRHKYEQMKQQEVQLKQQLSLYMDKFEEFQTTMAKSNELFTTFRQEMEKMTKKIKKLEKETIIWRTKWENNNKALLQMAEEKTVRDKEYKALQIKLERLEKLCRALQTERNELNEKVEVLKEQVSIKAAIKAANRDLATPVMQPCTALDSHKELNTSSKRALGAHLEAEPKSQRSAVQKPPSTGSAPAIESVD

SEQ ID NO: 86974 - protein, 456 aa, Homo sapiens
  Payload ID: 17406
  Gene Symbol: TLDC1
  Gene Name: TBC/LysM-associated domain containing 1
  Uniprot ID: Q6P9B6
  ENSP ID: ENSP00000343635
MGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKFTEDLVGSVVHVLSHRQELRGWTGKEAPGPNPRVQVLAAQLLSDMKLQDGKRLLGPQWLDYDCDRAVIEDWVFRVPHVAIFLSVVICKGFLILCSSLDLTTLVPERQVDQGRGFESILDVLSVMYINAQLPREQRHRWCLLFSSELHGHSFSQLCGHITHRGPCVAVLEDHDKHVFGGFASCSWEVKPQFQGDNRCFLFSICPSMAVYTHTGYNDHYMYLNHGQQTIPNGLGMGGQHNYFGLWVDVDFGKGHSRAKPTCTTYNSPQLSAQENFQFDKMEVWAVGDPSEEQLAKGNKSILDADPEAQALLEISGHSRHSEGLREVPDDE

SEQ ID NO: 86975 - protein, 193 aa, Homo sapiens
  Payload ID: 17406
  Gene Symbol: TLDC1
  Gene Name: TBC/LysM-associated domain containing 1
  ENSP ID: ENSP00000454265
MGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKFTEDLVGSVVHVLSHRQELRGWTGKEAPGPNPRVQVLAAQLLSDMKLQGKDFWGPSGWTMTVTEL

SEQ ID NO: 86976 - protein, 57 aa, Homo sapiens
  Payload ID: 17406
  Gene Symbol: TLDC1
  Gene Name: TBC/LysM-associated domain containing 1
  ENSP ID: ENSP00000455332
MGNSRSRVGRSFCSQFLPEEQAEIDQLFDALSSDKNSPNVSSKSFSLKALQKGTWSR

SEQ ID NO: 86977 - protein, 45 aa, Homo sapiens
  Payload ID: 17406
  Gene Symbol: TLDC1
  Gene Name: TBC/LysM-associated domain containing 1
  ENSP ID: ENSP00000455557
MGNSRSRVGRSFCSQFLPEEQAEIDQLFDALSSDKNSPNVSSKSF

SEQ ID NO: 86978 - protein, 83 aa, Homo sapiens
  Payload ID: 17406
  Gene Symbol: TLDC1
  Gene Name: TBC/LysM-associated domain containing 1
  ENSP ID: ENSP00000457115
MGNSRSRVGRSFCSQFLPEEQAEIDQLFDALSSDKNSPNVSSKSFSLKALQNHVGEALPPEMVTRLYDGMRRVDLTGKAKGPS

SEQ ID NO: 86979 - protein, 148 aa, Homo sapiens
  Payload ID: 17406
  Gene Symbol: TLDC1
  Gene Name: TBC/LysM-associated domain containing 1
  ENSP ID: ENSP00000457557
MGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKFTEDLVGSVVHVLSHRQELR

SEQ ID NO: 86980 - protein, 215 aa, Homo sapiens
  Payload ID: 17407
  Gene Symbol: TLDC2
  Gene Name: TBC/LysM-associated domain containing 2
  Uniprot ID: A0PJX2
  ENSP ID: ENSP00000217320
MRGLRWRYTRLPSQVEDTLSGEEGNEEEEEEEAAPDPAAAPEDPTVPQLTEASQVLSASEIRQLSFHFPPRVTGHPWSLVFCTSRDGFSLQSLYRRMEGCSGPVLLVLRDQDGQIFGAFSSSAIRLSKGFYGTGETFLFSFSPQLKVFKWTGSNSFFVKGDLDSLMMGSGSGRFGLWLDGDLFRGGSSPCPTFNNEVLARQEQFCIQELEAWLLS

SEQ ID NO: 86981 - protein, 27 aa, Homo sapiens
  Payload ID: 17407
  Gene Symbol: TLDC2
  Gene Name: TBC/LysM-associated domain containing 2
  ENSP ID: ENSP00000394804
VFKWTGSNSFFVKGDLDSLMMGSGRIL

SEQ ID NO: 86982 - protein, 215 aa, Homo sapiens; identical to SEQ ID NO: 86980
  Payload ID: 17407
  Gene Symbol: TLDC2
  Gene Name: TBC/LysM-associated domain containing 2
  Uniprot ID: A0PJX2
  ENSP ID: ENSP00000473323

SEQ ID NO: 86983 - protein, 1168 aa, Homo sapiens
  Payload ID: 17408
  Gene Symbol: TBC1D1
  Gene Name: TBC1 (tre-2/USP6, BUB2, cdc16) domain family, member 1
  Uniprot ID: Q86TI0
  ENSP ID: ENSP00000261439
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 86984 - protein, 144 aa, Homo sapiens
  Payload ID: 17408
  Gene Symbol: TBC1D1
  Gene Name: TBC1 (tre-2/USP6, BUB2, cdc16) domain family, member 1
  ENSP ID: ENSP00000383994
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKCSSSL

SEQ ID NO: 86985 - protein, 599 aa, Homo sapiens
  Payload ID: 17408
  Gene Symbol: TBC1D1
  Gene Name: TBC1 (tre-2/USP6, BUB2, cdc16) domain family, member 1
  ENSP ID: ENSP00000396877
MSPLFSWVAKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAI

SEQ ID NO: 86986 - protein, 252 aa, Homo sapiens
  Payload ID: 17408
  Gene Symbol: TBC1D1
  Gene Name: TBC1 (tre-2/USP6, BUB2, cdc16) domain family, member 1
  ENSP ID: ENSP00000397640
  MOD_RES (1)..(1): Any amino acid
XSILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKRDFESKANHLGDSGGTPVKTRRHSWRQQIFLRVATPQKACDSSSRYEDYSELGELPPRSPLEPVCEDGPF

SEQ ID NO: 86987 - protein, 226 aa, Homo sapiens
  Payload ID: 17408
  Gene Symbol: TBC1D1
  Gene Name: TBC1 (tre-2/USP6, BUB2, cdc16) domain family, member 1
  ENSP ID: ENSP00000410167
SLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQ

SEQ ID NO: 86988 - protein, 856 aa, Homo sapiens
  Payload ID: 17408
  Gene Symbol: TBC1D1
  Gene Name: TBC1 (tre-2/USP6, BUB2, cdc16) domain family, member 1
  ENSP ID: ENSP00000421641
  MOD_RES (1)..(1): Any amino acid
XCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 86989 - protein, 1159 aa, Homo sapiens
  Payload ID: 17408
  Gene Symbol: TBC1D1
  Gene Name: TBC1 (tre-2/USP6, BUB2, cdc16) domain family, member 1
  Uniprot ID: Q86TI0
  ENSP ID: ENSP00000423651
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 86990 - protein, 177 aa, Homo sapiens
  Payload ID: 17408
  Gene Symbol: TBC1D1
  Gene Name: TBC1 (tre-2/USP6, BUB2, cdc16) domain family, member 1
  ENSP ID: ENSP00000425655
  MOD_RES (1)..(1): Any amino acid
XMNSSKTKLELQKHLTTLTNQEQATIFEEVQKLRPRNEQRENELIISFLRCLYEEKQKEHIHIGEMKQEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGT

SEQ ID NO: 86991 - protein, 432 aa, Homo sapiens
  Payload ID: 17408
  Gene Symbol: TBC1D1
  Gene Name: TBC1 (tre-2/USP6, BUB2, cdc16) domain family, member 1
  ENSP ID: ENSP00000478039
MEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 86992 - protein, 893 aa, Homo sapiens
  Payload ID: 17409
  Gene Symbol: TBCK
  Gene Name: TBC1 domain containing kinase
  Uniprot ID: Q8TEA7
  ENSP ID: ENSP00000273980
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQYMNKHGIVHRALSPHNILLDRKGHIKLAKFGLYHMTAHGDDVDFPIGYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRPTPDQLMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 86993 - protein, 830 aa, Homo sapiens
  Payload ID: 17409
  Gene Symbol: TBCK
  Gene Name: TBC1 domain containing kinase
  Uniprot ID: Q8TEA7
  ENSP ID: ENSP00000355338
MFPLKDAEMGAFTFFASALPHDVCGSNGLPLTPNSIKILGRFQILKTITHPRLCQYVDISRGKHERLVVVAEHCERSLEDLLRERKPVRYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRPTPDQLMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 86994 - protein, 854 aa, Homo sapiens
  Payload ID: 17409
  Gene Symbol: TBCK
  Gene Name: TBC1 domain containing kinase
  Uniprot ID: Q8TEA7
  ENSP ID: ENSP00000378196
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQYMNKHGIVHRALSPHNILLDRKGHIKLAKFGLYHMTAHGDDVDFPIGYPSYLAPEGRKLFQSLDISERLKFLLTLDCVDDTLIVLAEEHGCLDIIKELPETVIDLLNKCLTFHPSKRPTPDQLMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 86995 - protein, 893 aa, Homo sapiens; identical to SEQ ID NO: 86992
  Payload ID: 17409
  Gene Symbol: TBCK
  Gene Name: TBC1 domain containing kinase
  Uniprot ID: Q8TEA7
  ENSP ID: ENSP00000378198

SEQ ID NO: 86996 - protein, 893 aa, Homo sapiens; identical to SEQ ID NO: 86992
  Payload ID: 17409
  Gene Symbol: TBCK
  Gene Name: TBC1 domain containing kinase
  Uniprot ID: Q8TEA7
  ENSP ID: ENSP00000405847

SEQ ID NO: 86997 - protein, 159 aa, Homo sapiens
  Payload ID: 17409
  Gene Symbol: TBCK
  Gene Name: TBC1 domain containing kinase
  ENSP ID: ENSP00000420985
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQYMNKHGIVHRALSPHNILLDRKGHIKLAKFGLYHMTAHGDDVDFPIGYPSYLAP

SEQ ID NO: 86998 - protein, 153 aa, Homo sapiens
  Payload ID: 17409
  Gene Symbol: TBCK
  Gene Name: TBC1 domain containing kinase
  ENSP ID: ENSP00000421182
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQYMNKHGIVHRALSPHNILLDRKGHIKLAKFGLYHMTAHGDDVDFPIGM

SEQ ID NO: 86999 - protein, 139 aa, Homo sapiens
  Payload ID: 17409
  Gene Symbol: TBCK
  Gene Name: TBC1 domain containing kinase
  ENSP ID: ENSP00000422160
  MOD_RES (1)..(1): Any amino acid
XTPDQLMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNEQTFCLQVGS

SEQ ID NO: 87000 - protein, 85 aa, Homo sapiens
  Payload ID: 17409
  Gene Symbol: TBCK
  Gene Name: TBC1 domain containing kinase
  ENSP ID: ENSP00000423092
  MOD_RES (1)..(1): Any amino acid
XYPSYLAPEVIAQGIFKTTDHMPSKKPLPSGPKSDVWSLGIILFELCVMRKVKLQVVLSSLPNLYNYLMVEESNLAHNHCSTHKC

SEQ ID NO: 87001 - protein, 68 aa, Homo sapiens
  Payload ID: 17409
  Gene Symbol: TBCK
  Gene Name: TBC1 domain containing kinase
  ENSP ID: ENSP00000423637
MFPLKDAEMGAFTFFASALPHDVCGSNGLPLTPNSIKILGRFQILKTITHPRLCQYVDISRGKHERLV

SEQ ID NO: 87002 - protein, 56 aa, Homo sapiens
  Payload ID: 17409
  Gene Symbol: TBCK
  Gene Name: TBC1 domain containing kinase
  ENSP ID: ENSP00000423834
MRGLTWAALLGVEGAIHAKYDAIDKDTPIPTDRQIEVDIPRCHQYDELLSSPEGHA

SEQ ID NO: 87003 - protein, 105 aa, Homo sapiens
  Payload ID: 17409
  Gene Symbol: TBCK
  Gene Name: TBC1 domain containing kinase
  ENSP ID: ENSP00000425197
MFPLKDAEMGAFTFFASALPHDVCGSNGLPLTPNSIKILGRFQILKTITHPRLCQYVDISRGKHERLVVVAEHCERSLEDLLRERKPVSCSTVLCIAFEVLQGLQ

SEQ ID NO: 87004 - protein, 24 aa, Homo sapiens
  Payload ID: 17409
  Gene Symbol: TBCK
  Gene Name: TBC1 domain containing kinase
  ENSP ID: ENSP00000426093
  MOD_RES (1)..(1): Any amino acid
XLFQSLDISERLKFLLTLGQPQIN

SEQ ID NO: 87005 - protein, 508 aa, Homo sapiens
  Payload ID: 17410
  Gene Symbol: TBC1D10A
  Gene Name: TBC1 domain family, member 10A
  Uniprot ID: Q9BXI6
  ENSP ID: ENSP00000215790
MAKSNGENGPRAPAAGESLSGTRESLAQGPDAATTDELSSLGSDSEANGFAERRIDKFGFIVGSQGAEGALEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 87006 - protein, 154 aa, Homo sapiens
  Payload ID: 17410
  Gene Symbol: TBC1D10A
  Gene Name: TBC1 domain family, member 10A
  ENSP ID: ENSP00000377484
MLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDG

SEQ ID NO: 87007 - protein, 515 aa, Homo sapiens
  Payload ID: 17410
  Gene Symbol: TBC1D10A
  Gene Name: TBC1 domain family, member 10A
  Uniprot ID: Q9BXI6
  ENSP ID: ENSP00000384996
MAKSNGENGPRAPAAGESLSGTRESLAQGPDAATTDELSSLGSDSEANGFAERRIDKFGFIVGSQGAEGAPCPLLHRLEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 87008 - protein, 420 aa, Homo sapiens
  Payload ID: 17410
  Gene Symbol: TBC1D10A
  Gene Name: TBC1 domain family, member 10A
  ENSP ID: ENSP00000385050
MLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGELQCRSPPRLHGAKAILDAEPGPRPALQPSPSIRLPLDAPLPGSKAKPKPPKQAQKEQRKQMKGRGQLEKPPAPNQAMVVAAAGDACPPQHVPPKDSAPKDSAPQDLAPQVSAHHRSQESLTSQESEDTYL

SEQ ID NO: 87009 - protein, 95 aa, Homo sapiens
  Payload ID: 17410
  Gene Symbol: TBC1D10A
  Gene Name: TBC1 domain family, member 10A
  ENSP ID: ENSP00000389994
MAKSNGENGPRAPAAGESLSGTRESLAQGPDAATTDELSSLGSDSEANGFAERRIDKFGFIVGSQGAEGAFVCGAKRASRLLCGAVLGSTCQEAR

SEQ ID NO: 87010 - protein, 296 aa, Homo sapiens
  Payload ID: 17410
  Gene Symbol: TBC1D10A
  Gene Name: TBC1 domain family, member 10A
  ENSP ID: ENSP00000400620
MERLEEVPLEVLRQRESKWLDMLNNWDKWMAKKHKKIRLRCQKGIPPSLRGRAWQYLSGGKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEGQLGGTCVTSFYT

SEQ ID NO: 87011 - protein, 808 aa, Homo sapiens
  Payload ID: 17411
  Gene Symbol: TBC1D10B
  Gene Name: TBC1 domain family, member 10B
  Uniprot ID: Q4KMP7
  ENSP ID: ENSP00000386538
METGTAPLVAPPRRHGAPAAPSPPPRGSRAGPVVVVAPGPPVTTATSAPVTLVAPGEARPAWVPGSAETSAPAPAPAPAPAPAVTGSTVVVLTLEASPEAPKPQLPSGPESPEPAAVAGVETSRALAAGADSPKTEEARPSPAPGPGTPTGTPTRTPSRTAPGALTAKPPLAPKPGTTVASGVTARSASGQVTGGHGAAAATSASAGQAPEDPSGPGTGPSGTCEAPVAVVTVTPAPEPAENSQDLGSTSSLGPGISGPRGQAPDTLSYLDSVSLMSGTLESLADDVSSMGSDSEINGLALRKTDKYGFLGGSQYSGSLESSIPVDVARQRELKWLDMFSNWDKWLSRRFQKVKLRCRKGIPSSLRAKAWQYLSNSKELLEQNPGKFEELERAPGDPKWLDVIEKDLHRQFPFHEMFAARGGHGQQDLYRILKAYTIYRPDEGYCQAQAPVAAVLLMHMPAEQAFWCLVQICDKYLPGYYSAGLEAIQLDGEIFFALLRRASPLAHRHLRRQRIDPVLYMTEWFMCIFARTLPWASVLRVWDMFFCEGVKIIFRVALVLLRHTLGSVEKLRSCQGMYETMEQLRNLPQQCMQEDFLVHEVTNLPVTEALIERENAAQLKKWRETRGELQYRPSRRLHGSRAIHEERRRQQPPLGPSSSLLSLPGLKSRGSRAAGGAPSPPPPVRRASAGPAPGPVVTAEGLHPSLPSPTGNSTPLGSSKETRKQEKERQKQEKERQKQEKEREKERQKQEKEREKQEKEREKQEKERQKQEKKAQGRKLSLRRKADGPPGPHDGGDRPSAEARQDAYF

SEQ ID NO: 87012 - protein, 184 aa, Homo sapiens
  Payload ID: 17411
  Gene Symbol: TBC1D10B
  Gene Name: TBC1 domain family, member 10B
  ENSP ID: ENSP00000456663
VKLRCRKGIPSSLRAKAWQYLSNSKELLEQNPGKFEELERAPGDPKWLDVIEKDLHRQFPFHEMFAARGGHGQQDLYRILKAYTIYRPDEGYCQAQAPVAAVLLMHMPAEQAFWCLVQICDKYLPGYYSAGLALRSSSGWPWSCCATRWAQWRSCAPAKACMRPWSSCVTCPSSACRKTSWCMR

SEQ ID NO: 87013 - protein, 310 aa, Homo sapiens
  Payload ID: 17412
  Gene Symbol: TBC1D10C
  Gene Name: TBC1 domain family, member 10C
  Uniprot ID: Q8IV04
  ENSP ID: ENSP00000310193
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGRGSCRCSRPTPCIDRSRATARPRGPWLLCCSCTCPQRRPSGAWCRSVRSTSLGTTGPTWCQSTVPCGADTGAPGAGHCRAARGLPWPPGDTGSPSSHPPRAAAGGGLHVTGAQRGAVRAGPAAGDQGPAGPAARFRAGTPAPATGPPRRGPSHL

SEQ ID NO: 87014 - protein, 310 aa, Homo sapiens; identical to SEQ ID NO: 87013
  Payload ID: 17412
  Gene Symbol: TBC1D10C
  Gene Name: TBC1 domain family, member 10C
  Uniprot ID: Q8IV04
  ENSP ID: ENSP00000435543

SEQ ID NO: 87015 - protein, 219 aa, Homo sapiens
  Payload ID: 17412
  Gene Symbol: TBC1D10C
  Gene Name: TBC1 domain family, member 10C
  ENSP ID: ENSP00000435829
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMVRG

SEQ ID NO: 87016 - protein, 446 aa, Homo sapiens
  Payload ID: 17412
  Gene Symbol: TBC1D10C
  Gene Name: TBC1 domain family, member 10C
  Uniprot ID: Q8IV04
  ENSP ID: ENSP00000443654
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMEAVRLDAEVFMALLRRLLPHVHKHLQQVGVGPLLYLPEWFLCLFARSLPFPTVLRVWDAFLSEGARVLFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 87017 - protein, 775 aa, Homo sapiens
  Payload ID: 17413
  Gene Symbol: TBC1D12
  Gene Name: TBC1 domain family, member 12
  Uniprot ID: O60347
  ENSP ID: ENSP00000225235
MVGPEDAGACSGRNPKLLPVPAPDPVGQDRKVIRATGGFGGGVGAVEPPEEADEEEEADEEEETPPRQLLQRYLAAAGEQLEPGLCYCPLPAGQAGAPPPSAAPRSDACLLGSGSKHRGAEVADGRAPRHEGMTNGDSGFLPGRDCRDLEEARGLARAGGRESRRRRPYGRLRLEGPGDEDADGAGSPSDWASPLEDPLRSCCLVAADAQEPEGAGSDSGDSPASSCSSSEDSEQRGVGAGGPEEGAPPATSAERTNGGAEPRLGFSDIHFNSRNTFQVSRGQSARDHLPPAGPPVPLPAAEQGPAGASARARRSGGFADFFTRNLFPKRTKELKSVVHSAPGWKLFGKVPPRENLQKTSKIIQQEYEARTGRTCKPPPQSSRRKNFEFEPLSTTALILEDRPSNLPAKSVEEALRHRQEYDEMVAEAKKREIKEAHKRKRIMKERFKQEENIASAMVIWINEILPNWEVMRSTRRVRELWWQGLPPSVRGKVWSLAVGNELNITPELYEIFLSRAKERWKSFSETSSENDTEGVSVADREASLELIKLDISRTFPSLYIFQKGGPYHDVLHSILGAYTCYRPDVGYVQGMSFIAAVLILNLEEADAFIAFANLLNKPCQLAFFRVDHSMMLKYFATFEVFFEENLSKLFLHFKSYSLTPDIYLIDWIFTLYSKSLPLDLACRVWDVFCRDGEEFLFRTGLGILRLYEDILLQMDFIHIAQFLTKLPEDITSEKLFSCIAAIQMQNSTKKWTQVFASVMKDIKEGDKNSSPALKS

SEQ ID NO: 87018 - protein, 275 aa, Homo sapiens
  Payload ID: 17414
  Gene Symbol: TBC1D13
  Gene Name: TBC1 domain family, member 13
  Uniprot ID: Q9NVG8
  ENSP ID: ENSP00000223865
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 87019 - protein, 400 aa, Homo sapiens
  Payload ID: 17414
  Gene Symbol: TBC1D13
  Gene Name: TBC1 domain family, member 13
  Uniprot ID: Q9NVG8
  ENSP ID: ENSP00000361731
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 87020 - protein, 465 aa, Homo sapiens
  Payload ID: 17415
  Gene Symbol: TBC1D14
  Gene Name: TBC1 domain family, member 14
  ENSP ID: ENSP00000386343
MMAISPALLFMDRNLLARKQSARLDKHNDLGWKLFGKAPLRENAQKDSKRIQKEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 87021 - protein, 693 aa, Homo sapiens
  Payload ID: 17415
  Gene Symbol: TBC1D14
  Gene Name: TBC1 domain family, member 14
  Uniprot ID: Q9P2M4
  ENSP ID: ENSP00000386921
MTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKSSTFPRTGYDSVKLYSPTSKALTRSDDVSVCSVSSLGTELSTTLSVSNEDILDLVVTSSSSAIVTLENDDDPQFTNVTLSSIKETRGLHQQDCVHEAEEGSKLKILGPFSNFFARNLLARKQSARLDKHNDLGWKLFGKAPLRENAQKDSKRIQKEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 87022 - protein, 413 aa, Homo sapiens
  Payload ID: 17415
  Gene Symbol: TBC1D14
  Gene Name: TBC1 domain family, member 14
  Uniprot ID: Q9P2M4
  ENSP ID: ENSP00000388886
MEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 87023 - protein, 200 aa, Homo sapiens
  Payload ID: 17415
  Gene Symbol: TBC1D14
  Gene Name: TBC1 domain family, member 14
  ENSP ID: ENSP00000389082
LPNWETMWCSRKVRDLWWQGIPPSVRGKVWSLAIGNELNITHELFDICLARAKERWRSLSTGGSEVENEDAGFSAADREASLELIKLDISRTFPNLCIFQQVLIFVDFRVGLQKSFQKRKERESTKLQQLWSWCLGGPYHDMLHSILGAYTCYRPDVGYVQGMSFIAAVLILNLDTADAFIAFSNLLNKPCQMAFFRVDH

SEQ ID NO: 87024 - protein, 693 aa, Homo sapiens; identical to SEQ ID NO: 87021
  Payload ID: 17415
  Gene Symbol: TBC1D14
  Gene Name: TBC1 domain family, member 14
  Uniprot ID: Q9P2M4
  ENSP ID: ENSP00000404041

SEQ ID NO: 87025 - protein, 353 aa, Homo sapiens
  Payload ID: 17415
  Gene Symbol: TBC1D14
  Gene Name: TBC1 domain family, member 14
  ENSP ID: ENSP00000405875
MVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 87026 - protein, 56 aa, Homo sapiens
  Payload ID: 17415
  Gene Symbol: TBC1D14
  Gene Name: TBC1 domain family, member 14
  ENSP ID: ENSP00000411760
MTDGKLSTSTNGVAFMGILDGRPGNPLQNLQHVNLKAPRLLSAPEYGPKLKLRALE

SEQ ID NO: 87027 - protein, 127 aa, Homo sapiens
  Payload ID: 17415
  Gene Symbol: TBC1D14
  Gene Name: TBC1 domain family, member 14
  ENSP ID: ENSP00000414951
MTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKS

SEQ ID NO: 87028 - protein, 682 aa, Homo sapiens
  Payload ID: 17416
  Gene Symbol: TBC1D15
  Gene Name: TBC1 domain family, member 15
  Uniprot ID: Q8TC07
  ENSP ID: ENSP00000318262
MCPGLYPYSSLLEYGRSMIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 87029 - protein, 49 aa, Homo sapiens
  Payload ID: 17416
  Gene Symbol: TBC1D15
  Gene Name: TBC1 domain family, member 15
  ENSP ID: ENSP00000417308
MAAAGVVSGKATLSARYSRILTDDSLGDRWCYFLKSLICSSLSFSQDYI

SEQ ID NO: 87030 - protein, 278 aa, Homo sapiens
  Payload ID: 17416
  Gene Symbol: TBC1D15
  Gene Name: TBC1 domain family, member 15
  ENSP ID: ENSP00000418091
MVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSIS

SEQ ID NO: 87031 - protein, 124 aa, Homo sapiens
  Payload ID: 17416
  Gene Symbol: TBC1D15
  Gene Name: TBC1 domain family, member 15
  ENSP ID: ENSP00000418467
MAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDLHRIKEHFL

SEQ ID NO: 87032 - protein, 85 aa, Homo sapiens
  Payload ID: 17416
  Gene Symbol: TBC1D15
  Gene Name: TBC1 domain family, member 15
  ENSP ID: ENSP00000419365
MAAAGVVSGKIIYEQEGVYIHSSCGKTNDQDGLISGILRVLEKDAEVIVDWRPLDDALDSSSILYARKMLQVIEMGKANGHSCSV

SEQ ID NO: 87033 - protein, 72 aa, Homo sapiens
  Payload ID: 17416
  Gene Symbol: TBC1D15
  Gene Name: TBC1 domain family, member 15
  ENSP ID: ENSP00000420190
MAAAGVVSGKIIYEQEGVYIHSSCGKTNDQDGLISGILRVLEKDAEVIVDWRPLDDALDSSSILYARKISTG

SEQ ID NO: 87034 - protein, 674 aa, Homo sapiens
  Payload ID: 17416
  Gene Symbol: TBC1D15
  Gene Name: TBC1 domain family, member 15
  Uniprot ID: Q8TC07
  ENSP ID: ENSP00000420678
MAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 87035 - protein, 691 aa, Homo sapiens
  Payload ID: 17416
  Gene Symbol: TBC1D15
  Gene Name: TBC1 domain family, member 15
  Uniprot ID: Q8TC07
  ENSP ID: ENSP00000448182
MAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQAGLLDRRKLLWAIHHWKKIKKDPYTATMIGFSKVTNYIFDSLRGSDPSTHQRPPSEMADFLSDAIPGLKINQQEEPGFEVITRIDLGERPVVQRREPVSLEEWTKNIDSEGRILNVDNMKQMIFRGGLSHALRKQAWKFLLGYFPWDSTKEERTQLQKQKTDEYFRMKLQWKSISQEQEKRNSRLRDYRSLIEKDVNRTDRTNKFYEGQDNPGLILLHDILMTYCMYDFDLGYVQGMSDLLSPLLYVMENEVDAFWCFASYMDQMHQNFEEQMQGMKTQLIQLSTLLRLLDSGFCSYLESQDSGYLYFCFRWLLIRFKREFSFLDILRLWEVMWTELPCTNFHLLLCCAILESEKQQIMEKHYGFNEILKHINELSMKIDVEDILCKAEAISLQMVKCKELPQAVCEILGLQGSEVTTPDSDVGEDENVVMTPCPTSAFQSNALPTLSASGARNDSPTQIPVSSDVCRLTPA

SEQ ID NO: 87036 - protein, 120 aa, Homo sapiens
  Payload ID: 17416
  Gene Symbol: TBC1D15
  Gene Name: TBC1 domain family, member 15
  ENSP ID: ENSP00000449643
MVNTVSFKRKPHTNGDAPSHRNGKSKWSFLFSLTDLKSIKQNKEGMGWSYLVFCLKDDVVLPALHFHQGDSKLLIESLEKYVVLCESPQDKRTLLVNCQNKSLSQSFENLLDEPAYGLIQ

SEQ ID NO: 87037 - protein, 767 aa, Homo sapiens
  Payload ID: 17417
  Gene Symbol: TBC1D16
  Gene Name: TBC1 domain family, member 16
  Uniprot ID: Q8TBP0
  ENSP ID: ENSP00000309794
MSLGRLLRRASSKASDLLTLTPGGSGSGSPSVLDGEIIYSKNNVCVHPPEGLQGLGEHHPGYLCLYMEKDEMLGATLILAWVPNSRIQRQDEEALRYITPESSPVRKAPRPRGRRTRSSGASHQPSPTELRPTLTPKDEDILVVAQSVPDRMLASPAPEDEEKLAQGLGVDGAQPASQPACSPSGILSTVSPQDVTEEGREPRPEAGEEDGSLELSAEGVSRDSSFDSDSDTFSSPFCLSPISAALAESRGSVFLESDSSPPSSSDAGLRFPDSNGLLQTPRWDEPQRVCALEQICGVFRVDLGHMRSLRLFFSDEACTSGQLVVASRESQYKVFHFHHGGLDKLSDVFQQWKYCTEMQLKDQQVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGFGFRR

SEQ ID NO: 87038 - protein, 405 aa, Homo sapiens
  Payload ID: 17417
  Gene Symbol: TBC1D16
  Gene Name: TBC1 domain family, member 16
  Uniprot ID: Q8TBP0
  ENSP ID: ENSP00000341517
MKVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGFGFRR

SEQ ID NO: 87039 - protein, 188 aa, Homo sapiens
  Payload ID: 17417
  Gene Symbol: TBC1D16
  Gene Name: TBC1 domain family, member 16
  ENSP ID: ENSP00000458356
MQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQ

SEQ ID NO: 87040 - protein, 279 aa, Homo sapiens
  Payload ID: 17417
  Gene Symbol: TBC1D16
  Gene Name: TBC1 domain family, member 16
  ENSP ID: ENSP00000458377
MKQVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQGADV

SEQ ID NO: 87041 - protein, 278 aa, Homo sapiens
  Payload ID: 17417
  Gene Symbol: TBC1D16
  Gene Name: TBC1 domain family, member 16
  Uniprot ID: Q8TBP0
  ENSP ID: ENSP00000458766
MKVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQGADV

SEQ ID NO: 87042 - protein, 130 aa, Homo sapiens
  Payload ID: 17417
  Gene Symbol: TBC1D16
  Gene Name: TBC1 domain family, member 16
  ENSP ID: ENSP00000459342
MRSLRLFFSQGCPAADITNERPGLRRSRRVQKLGGFPDPEPHSSLSSKGSRGWADSTDGCLLSFPGGFSQSSTHTQRRSDEACTSGQLVVASRESQYKVFHFHHGGLDKLSDVFQQWKYCTEMQLKDQQV

SEQ ID NO: 87043 - protein, 190 aa, Homo sapiens
  Payload ID: 17417
  Gene Symbol: TBC1D16
  Gene Name: TBC1 domain family, member 16
  ENSP ID: ENSP00000461509
MQFSIRRPKLPSSETHPEESMYKRLGVSAWLNHLNELGQVEEEYKLRKVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQ

SEQ ID NO: 87044 - protein, 392 aa, Homo sapiens
  Payload ID: 17417
  Gene Symbol: TBC1D16
  Gene Name: TBC1 domain family, member 16
  Uniprot ID: Q8TBP0
  ENSP ID: ENSP00000461522
MKQVAPDKTCMQFSIRRPKLPSSETHPEESMYKRLGVSAWLNHLNELGQVEEEYKLRKVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGFGFRR

SEQ ID NO: 87045 - protein, 257 aa, Homo sapiens
  Payload ID: 17417
  Gene Symbol: TBC1D16
  Gene Name: TBC1 domain family, member 16
  ENSP ID: ENSP00000461531
  MOD_RES (1)..(1): Any amino acid
XSSTHTQRRSDEACTSGQLVVASRESQYKVFHFHHGGLDKLSDVFQQWKYCTEMQLKDQVAPDKTCMQFSIRRPKLPSSETHPEESMYKRLGVSAWLNHLNELGQVEEEYKLRKVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQL

SEQ ID NO: 87046 - protein, 648 aa, Homo sapiens
  Payload ID: 17418
  Gene Symbol: TBC1D17
  Gene Name: TBC1 domain family, member 17
  Uniprot ID: Q9HA65
  ENSP ID: ENSP00000221543
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQLCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 87047 - protein, 615 aa, Homo sapiens
  Payload ID: 17418
  Gene Symbol: TBC1D17
  Gene Name: TBC1 domain family, member 17
  Uniprot ID: Q9HA65
  ENSP ID: ENSP00000446323
MEGAGYRDNDVLLHWAPVEEAGDSTQILFSKKDSSGGDSCASEEEPTFDPGYEPDWAVISTVRPQLCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 87048 - protein, 75 aa, Homo sapiens
  Payload ID: 17418
  Gene Symbol: TBC1D17
  Gene Name: TBC1 domain family, member 17
  ENSP ID: ENSP00000469010
MEGAGYRVVFEKGGVYLHTSAKKYQDRDSLIAGVIRVVEKDNDVLLHWAPVEEAGDSTQILFSKKGPEVSRHPQS

SEQ ID NO: 87049 - protein, 344 aa, Homo sapiens
  Payload ID: 17418
  Gene Symbol: TBC1D17
  Gene Name: TBC1 domain family, member 17
  ENSP ID: ENSP00000469747
TTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHEAQSGRSGGGG

SEQ ID NO: 87050 - protein, 480 aa, Homo sapiens
  Payload ID: 17418
  Gene Symbol: TBC1D17
  Gene Name: TBC1 domain family, member 17
  ENSP ID: ENSP00000472647
  MOD_RES (1)..(1): Any amino acid
XKYQDRDSLIAGVIRVVEKDNDVLLHWAPVEEAGDSTQILFSKKDSSGGDSCASEEEPTFDPGYEPDWAVISTVRPQLCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLGTVAHTCNPSTLGGQGGRIT

SEQ ID NO: 87051 - protein, 208 aa, Homo sapiens [sequence omitted]

SEQ ID NO: 87052 - protein, 526 aa, Homo sapiens
  Payload ID: 17419
  Gene Symbol: TBC1D19
  Gene Name: TBC1 domain family, member 19
  Uniprot ID: Q8N5T2
  ENSP ID: ENSP00000264866
MLQEESDLSLIIAQIVQKLKGSNLYSQLERQAWASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 87053 - protein, 223 aa, Homo sapiens
  Payload ID: 17419
  Gene Symbol: TBC1D19
  Gene Name: TBC1 domain family, member 19
  ENSP ID: ENSP00000423097
MLQEESDLSLIIAQIVQKLKGSNLYSQLERQAWGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHD

SEQ ID NO: 87054 - protein, 68 aa, Homo sapiens
  Payload ID: 17419
  Gene Symbol: TBC1D19
  Gene Name: TBC1 domain family, member 19
  ENSP ID: ENSP00000423116
MTRTRARYDQASLQRPEIKLESLKEDIKEFFKISGWEKKLQNAVYSELSVFPLPSHPAAPPEHLKEPL

SEQ ID NO: 87055 - protein, 117 aa, Homo sapiens
  Payload ID: 17419
  Gene Symbol: TBC1D19
  Gene Name: TBC1 domain family, member 19
  ENSP ID: ENSP00000425176
MASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLF

SEQ ID NO: 87056 - protein, 461 aa, Homo sapiens
  Payload ID: 17419
  Gene Symbol: TBC1D19
  Gene Name: TBC1 domain family, member 19
  Uniprot ID: Q8N5T2
  ENSP ID: ENSP00000425569
MLQEESDLSLIIAQIVQKLKGSNLYSQLERQAWGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 87057 - protein, 267 aa, Homo sapiens
  Payload ID: 17419
  Gene Symbol: TBC1D19
  Gene Name: TBC1 domain family, member 19
  ENSP ID: ENSP00000427033
MKASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKD

SEQ ID NO: 87058 - protein, 710 aa, Homo sapiens
  Payload ID: 17420
  Gene Symbol: TBC1D2
  Gene Name: TBC1 domain family, member 2
  Uniprot ID: Q9BYX2
  ENSP ID: ENSP00000341567
MHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 87059 - protein, 468 aa, Homo sapiens
  Payload ID: 17420
  Gene Symbol: TBC1D2
  Gene Name: TBC1 domain family, member 2
  Uniprot ID: Q9BYX2
  ENSP ID: ENSP00000364203
MEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 87060 - protein, 860 aa, Homo sapiens
  Payload ID: 17420
  Gene Symbol: TBC1D2
  Gene Name: TBC1 domain family, member 2
  Uniprot ID: Q9BYX2
  ENSP ID: ENSP00000364205
MEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSR

SEQ ID NO: 87061 - protein, 917 aa, Homo sapiens
  Payload ID: 17420
  Gene Symbol: TBC1D2
  Gene Name: TBC1 domain family, member 2
  Uniprot ID: Q9BYX2
  ENSP ID: ENSP00000364207
MEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 87062 - protein, 928 aa, Homo sapiens
  Payload ID: 17420
  Gene Symbol: TBC1D2
  Gene Name: TBC1 domain family, member 2
  Uniprot ID: Q9BYX2
  ENSP ID: ENSP00000481721
MEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 87063 - protein, 403 aa, Homo sapiens
  Payload ID: 17421
  Gene Symbol: TBC1D20
  Gene Name: TBC1 domain family, member 20
  Uniprot ID: Q96BZ9
  ENSP ID: ENSP00000346139
MALRSAQGDGPTSGHWDGGAEKADFNAKRKKKVAEIHQALNSDPTDVAALRRMAISEGGLLTDEIRRKVWPKLLNVNANDPPPISGKNLRQMSKDYQQVLLDVRRSLRRFPPGMPEEQREGLQEELIDIILLILERNPQLHYYQGYHDIVVTFLLVVGERLATSLVEKLSTHHLRDFMDPTMDNTKHILNYLMPIIDQVNPELHDFMQSAEVGTIFALSWLITWFGHVLSDFRHVVRLYDFFLACHPLMPIYFAAVIVLYREQEVLDCDCDMASVHHLLSQIPQDLPYETLISRAGDLFVQFPPSELAREAAAQQQAERTAASTFKDFELASAQQRPDMVLRQRFRGLLRPEDRTKDVLTKPRTNRFVKLAVMGLTVALGAAALAVVKSALEWAPKFQLQLFP

SEQ ID NO: 87064 - protein, 403 aa, Homo sapiens; identical to SEQ ID NO: 87063
  Payload ID: 17421
  Gene Symbol: TBC1D20
  Gene Name: TBC1 domain family, member 20
  Uniprot ID: Q96BZ9
  ENSP ID: ENSP00000432280

SEQ ID NO: 87065 - protein, 336 aa, Homo sapiens
  Payload ID: 17422
  Gene Symbol: TBC1D21
  Gene Name: TBC1 domain family, member 21
  Uniprot ID: Q8IYX1
  ENSP ID: ENSP00000300504
MTTLSPENSLSARQSASFILVKRKPPIDKTEWDSFFDESGHLAKSRDFICVNILERGLHPFVRTEAWKFLTGYFSWQSSQDERLTVDSMRRKNYKALCQMYEKIQPLLENLHRNFTETRNNIARDIQKIYDKDPLGNVLIDKKRLEKILLLSYVCNTQAEYQQGFHEMMMLFQLMVEHDHETFWLFQFFLQKTEHSCVINIGVAKNLDMLSTLITFLDPVFAEHLKGKGAGAVQSLFPWFCFCFQRAFKSFDDVWRLWEVLLTGKPCRNFQVLVAYSMLQMVREQVLQESMGGDDILLACNNLIDLDADELISAACVVYAELIQKDVPQTLKDFFL

SEQ ID NO: 87066 - protein, 300 aa, Homo sapiens
  Payload ID: 17422
  Gene Symbol: TBC1D21
  Gene Name: TBC1 domain family, member 21
  Uniprot ID: Q8IYX1
  ENSP ID: ENSP00000439325
MTTLSPENSLSARQSASFILGLHPFVRTEAWKFLTGYFSWQSSQDERLTVDSMRRKNYKALCQMYEKIQPLLENLHRNFTETRNNIARDIQKIYDKDPLGNVLIDKKRLEKILLLSYVCNTQAEYQQGFHEMMMLFQLMVEHDHETFWLFQFFLQKTEHSCVINIGVAKNLDMLSTLITFLDPVFAEHLKGKGAGAVQSLFPWFCFCFQRAFKSFDDVWRLWEVLLTGKPCRNFQVLVAYSMLQMVREQVLQESMGGDDILLACNNLIDLDADELISAACVVYAELIQKDVPQTLKDFFL

SEQ ID NO: 87067 - protein, 299 aa, Homo sapiens
  Payload ID: 17422
  Gene Symbol: TBC1D21
  Gene Name: TBC1 domain family, member 21
  ENSP ID: ENSP00000457096
MTTLSPENSLSARQSASFILVKRKPPIDKTEWDSFFDESGHLAKSRDFICVNILERGLHPFVRTEAWKFLTGYFSWQSSQDERLTVDSMRRKNYKALCQMYEKIQPLLENLHRNFTETRNNIEYQQGFHEMMMLFQLMVEHDHETFWLFQFFLQKTEHSCVINIGVAKNLDMLSTLITFLDPVFAEHLKGKGAGAVQSLFPWFCFCFQRAFKSFDDVWRLWEVLLTGKPCRNFQVLVAYSMLQMVREQVLQESMGGDDILLACNNLIDLDADELISAACVVYAELIQKDVPQTLKDFFL

SEQ ID NO: 87068 - protein, 517 aa, Homo sapiens
  Payload ID: 17423
  Gene Symbol: TBC1D22A
  Gene Name: TBC1 domain family, member 22A
  Uniprot ID: Q8WUA7
  ENSP ID: ENSP00000336724
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 87069 - protein, 439 aa, Homo sapiens
  Payload ID: 17423
  Gene Symbol: TBC1D22A
  Gene Name: TBC1 domain family, member 22A
  Uniprot ID: Q8WUA7
  ENSP ID: ENSP00000347932
MASDGARKQFWKRSNSKLPGSLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 87070 - protein, 487 aa, Homo sapiens
  Payload ID: 17423
  Gene Symbol: TBC1D22A
  Gene Name: TBC1 domain family, member 22A
  ENSP ID: ENSP00000370383
MWEPQPDVGSLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 87071 - protein, 237 aa, Homo sapiens
  Payload ID: 17423
  Gene Symbol: TBC1D22A
  Gene Name: TBC1 domain family, member 22A
  ENSP ID: ENSP00000377964
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLGLPSRQCRPETSHSPEKTKRIFCIY

SEQ ID NO: 87072 - protein, 458 aa, Homo sapiens
  Payload ID: 17423
  Gene Symbol: TBC1D22A
  Gene Name: TBC1 domain family, member 22A
  ENSP ID: ENSP00000384036
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 87073 - protein, 470 aa, Homo sapiens
  Payload ID: 17423
  Gene Symbol: TBC1D22A
  Gene Name: TBC1 domain family, member 22A
  Uniprot ID: Q8WUA7
  ENSP ID: ENSP00000385634
MPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 87074 - protein, 58 aa, Homo sapiens
  Payload ID: 17423
  Gene Symbol: TBC1D22A
  Gene Name: TBC1 domain family, member 22A
  ENSP ID: ENSP00000398828
MASDGARKQFWKRSNSKLPGRDGVSLCYPGWSRSPDLVIRPPRPPDKTGFLCSCDMLL

SEQ ID NO: 87075 - protein, 324 aa, Homo sapiens
  Payload ID: 17423
  Gene Symbol: TBC1D22A
  Gene Name: TBC1 domain family, member 22A
  Uniprot ID: Q8WUA7
  ENSP ID: ENSP00000406214
MPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIAFPGCGRPQIPILAVIWRDEPYPRTDEQIILRR

SEQ ID NO: 87076 - protein, 505 aa, Homo sapiens
  Payload ID: 17424
  Gene Symbol: TBC1D22B
  Gene Name: TBC1 domain family, member 22B
  Uniprot ID: Q9NU19
  ENSP ID: ENSP00000362590
MAAENSKQFWKRSAKLPGSIQPVYGAQHPPLDPRLTKNFIKERSKVNTVPLKNKKASSFHEFARNTSDAWDIGDDEEEDFSSPSFQTLNSKVALATAAQVLENHSKLRVKPERSQSTTSDVPANYKVIKSSSDAQLSRNSSDTCLRNPLHKQQSLPLRPIIPLVARISDQNASGAPPMTVREKTRLEKFRQLLSSQNTDLDELRKCSWPGVPREVRPITWRLLSGYLPANTERRKLTLQRKREEYFGFIEQYYDSRNEEHHQDTYRQIHIDIPRTNPLIPLFQQPLVQEIFERILFIWAIRHPASGYVQGINDLVTPFFVVFLSEYVEEDVENFDVTNLSQDMLRSIEADSFWCMSKLLDGIQDNYTFAQPGIQKKVKALEELVSRIDEQVHNHFRRYEVEYLQFAFRWMNNLLMRELPLRCTIRLWDTYQSEPEGFSHFHLYVCAAFLIKWRKEILDEEDFQGLLMLLQNLPTIHWGNEEIGLLLAEAYRLKYMFADAPNHYRR

SEQ ID NO: 87077 - protein, 684 aa, Homo sapiens
  Payload ID: 17425
  Gene Symbol: TBC1D23
  Gene Name: TBC1 domain family, member 23
  Uniprot ID: Q9NUY8
  ENSP ID: ENSP00000340693
MAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 87078 - protein, 699 aa, Homo sapiens
  Payload ID: 17425
  Gene Symbol: TBC1D23
  Gene Name: TBC1 domain family, member 23
  Uniprot ID: Q9NUY8
  ENSP ID: ENSP00000377700
MAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRMSFNLPWPDRSCTERHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 87079 - protein, 189 aa, Homo sapiens
  Payload ID: 17425
  Gene Symbol: TBC1D23
  Gene Name: TBC1 domain family, member 23
  ENSP ID: ENSP00000417487
MAEGEDVPPLPTSSGDGWEKDLEEALEAGGCDLETLRNIIQGRPLPADLRAKVWKSLFKSFFQIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPE

SEQ ID NO: 87080 - protein, 562 aa, Homo sapiens
  Payload ID: 17425
  Gene Symbol: TBC1D23
  Gene Name: TBC1 domain family, member 23
  ENSP ID: ENSP00000418059
MGWYFRLARTEHYSQRLPAVYWDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRMSFNLPWPDRSCTERHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 87081 - protein, 171 aa, Homo sapiens
  Payload ID: 17425
  Gene Symbol: TBC1D23
  Gene Name: TBC1 domain family, member 23
  ENSP ID: ENSP00000418714
MESREKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSY

SEQ ID NO: 87082 - protein, 559 aa, Homo sapiens
  Payload ID: 17426
  Gene Symbol: TBC1D24
  Gene Name: TBC1 domain family, member 24
  Uniprot ID: Q9ULP9
  ENSP ID: ENSP00000293970
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKSVSLSKRQFVHLAVHAENFRSEIVSVREMRDIWSWVPERFALCQPLLLFSSLQHGYSLARFYFQCEGHEPTLLLIKTTQKEVCGAYLSTDWSERNKFGGKLGFFGTGECFVFRLQPEVQRYEWVVIKHPELTKPPPLMAAEPTAPLSHSASSDPADRLSPFLAARHFNLPSKTESMFMAGGSDCLIVGGGGGQALYIDGDLNRGRTSHCDTFNNQPLCSENFLIAAVEAWGFQDPDTQ

SEQ ID NO: 87083 - protein, 553 aa, Homo sapiens
  Payload ID: 17426
  Gene Symbol: TBC1D24
  Gene Name: TBC1 domain family, member 24
  Uniprot ID: Q9ULP9
  ENSP ID: ENSP00000454408
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKRQFVHLAVHAENFRSEIVSVREMRDIWSWVPERFALCQPLLLFSSLQHGYSLARFYFQCEGHEPTLLLIKTTQKEVCGAYLSTDWSERNKFGGKLGFFGTGECFVFRLQPEVQRYEWVVIKHPELTKPPPLMAAEPTAPLSHSASSDPADRLSPFLAARHFNLPSKTESMFMAGGSDCLIVGGGGGQALYIDGDLNRGRTSHCDTFNNQPLCSENFLIAAVEAWGFQDPDTQ

SEQ ID NO: 87084 - protein, 19 aa, Homo sapiens
  Payload ID: 17426
  Gene Symbol: TBC1D24
  Gene Name: TBC1 domain family, member 24
  ENSP ID: ENSP00000455005
ENFLIAAVEAWGFQDPDTQ

SEQ ID NO: 87085 - protein, 69 aa, Homo sapiens
  Payload ID: 17426
  Gene Symbol: TBC1D24
  Gene Name: TBC1 domain family, member 24
  ENSP ID: ENSP00000457266
  MOD_RES (1)..(1): Any amino acid
XVPERFALCQPLLLFSSLQHGYSLARCVVLTCPQTGVREISLEANWASLGPENALCLGCSLRCSATSGW

SEQ ID NO: 87086 - protein, 53 aa, Homo sapiens
  Payload ID: 17426
  Gene Symbol: TBC1D24
  Gene Name: TBC1 domain family, member 24
  ENSP ID: ENSP00000457896
MDSPGYNCFVDKDKMDAAIQDLGPKELSCTELQELKQLARQGYWAQSHALRGK

SEQ ID NO: 87087 - protein, 553 aa, Homo sapiens; identical to SEQ ID NO: 87083
  Payload ID: 17426
  Gene Symbol: TBC1D24
  Gene Name: TBC1 domain family, member 24
  Uniprot ID: Q9ULP9
  ENSP ID: ENSP00000486121

SEQ ID NO: 87088 - protein, 339 aa, Homo sapiens
  Payload ID: 17426
  Gene Symbol: TBC1D24
  Gene Name: TBC1 domain family, member 24
  ENSP ID: ENSP00000486835
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKSLYTWPSMQRTSARRSSA

SEQ ID NO: 87089 - protein, 688 aa, Homo sapiens
  Payload ID: 17427
  Gene Symbol: TBC1D25
  Gene Name: TBC1 domain family, member 25
  Uniprot ID: Q3MII6
  ENSP ID: ENSP00000365962
MATASGASDLSGSGAPPPGVGAQAAAAAEEEEREVVRVRVKKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPLSDAEFHTYLNHEGQLSRPEELRLRIYHGGVEPSLRKVVWRYLLNVYPDGLTGRERMDYMKRKSREYEQLKSEWAQRANPEDLEFIRSTVLKDVLRTDRAHPYYAGPEDGPHLRALHDLLTTYAVTHPQVSYCQGMSDLASPILAVMDHEGHAFVCFCGIMKRLAANFHPDGRAMATKFAHLKLLLRHADPDFYQYLQEAGADDLFFCYRWLLLELKREFAFDDALRMLEVTWSSLPPDPPEHEVELVGPPSQVADAGFGGHRGWPVRQRHMLRPAGGGGSTFEDAVDHLATASQGPGGGGRLLRQASLDGLQQLRDNMGSRRDPLVQLPHPAALISSKSLSEPLLNSPDPLLSSFSHPDSPSSSSPPSTQEASPTGDMAVGSPLMQEVGSPKDPGKSLPPVPPMGLPPPQEFGRGNPFMLFLCLAILLEHRDHIMRNGLDYNELAMHFDRLVRKHHLGRVLRRARALFADYLQSEVWDSEEGAEATAAS

SEQ ID NO: 87090 - protein, 230 aa, Homo sapiens
  Payload ID: 17427
  Gene Symbol: TBC1D25
  Gene Name: TBC1 domain family, member 25
  ENSP ID: ENSP00000402268
MATASGASDLSGSGAPPPGVGAQAAAAAEEEEREVVRVRVKHGDGAPGGLPHVFSPQKCESFLPPEFRSFAVDPQITSLDVLQHILIRAFDLSGKKNFGISYLGRDRLGQEVYLSLLSDWDLSTAFATASKPYLQLRVDIRPSEDSPLLEDWDIISPKDVIGSDVLLAEKRSSLTTAALPFTQSILTQVGRTLSKVQQVLSWSYGEDVKPFKPPLSDAEFHTYLNHEGQL

SEQ ID NO: 87091 - protein, 100 aa, Homo sapiens
  Payload ID: 17427
  Gene Symbol: TBC1D25
  Gene Name: TBC1 domain family, member 25
  Uniprot ID: Q3MII6
  ENSP ID: ENSP00000476787
MATASGASDLSGSGAPPPGVGAQAAAAAEEEEREVVRVRVKKCESFLPPEFRSFAVDPQITSLDVLQHILIRAFDLSGPIARRLGHNQPQRCHWLRRVAG

SEQ ID NO: 87092 - protein, 511 aa, Homo sapiens
  Payload ID: 17428
  Gene Symbol: TBC1D26
  Gene Name: TBC1 domain family, member 26
  Uniprot ID: Q9HBT8
  ENSP ID: ENSP00000408168
MGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 87093 - protein, 250 aa, Homo sapiens
  Payload ID: 17428
  Gene Symbol: TBC1D26
  Gene Name: TBC1 domain family, member 26
  ENSP ID: ENSP00000410111
MEMDGDPYNLPAQGQGNIIITKYEQGHRAGAAVDLGHEQVDVRKYTNNLGIVHEMELPHVSALEVKQRRKESKRTNKWQKMLADWTKYRSTKKLSQRVYKVIPLAVRGRAWSLLLDIDRIKSQNPGKYKVMKEKGKRSSRIIHCIQLDVSHTLQKHMMFIQRFGVKQQELCDILVAYSAYNPEVGYHRDLSRITAILLLCLPEEDAFWALTQLLAGERHSLWYSTAQILPGSRGSYRTRSRCCTSPSQRS

SEQ ID NO: 87094 - protein, 250 aa, Homo sapiens; identical to SEQ ID NO: 87093
  Payload ID: 17428
  Gene Symbol: TBC1D26
  Gene Name: TBC1 domain family, member 26
  Uniprot ID: Q86UD7
  ENSP ID: ENSP00000434391

SEQ ID NO: 87095 - protein, 521 aa, Homo sapiens
  Payload ID: 17428
  Gene Symbol: TBC1D26
  Gene Name: TBC1 domain family, member 26
  Uniprot ID: Q9HBT8
  ENSP ID: ENSP00000458062
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 87096 - protein, 210 aa, Homo sapiens
  Payload ID: 17428
  Gene Symbol: TBC1D26
  Gene Name: TBC1 domain family, member 26
  Uniprot ID: Q86UD7
  ENSP ID: ENSP00000463097
MEMDGDPYNLPAQGQGNIIITKYEQGHRAGAAVDLGHEQVDVRKYTNNLGIVHEMELPHVSALEVKQRRKESKRTNKWQKMLADWTKYRSTKKLSQRVYKVIPLAVRGRAWSLLLDIDRIKSQNPGKYKVMKEKGKRSSRIIHCIQLDVSHTLQKHMMFIQRFGVKQQELCDILVAYSAYNPVSIPGQRYSWDMCPYSQAWVSLGGVATS

SEQ ID NO: 87097 - protein, 52 aa, Homo sapiens
  Payload ID: 17428
  Gene Symbol: TBC1D26
  Gene Name: TBC1 domain family, member 26
  ENSP ID: ENSP00000463606
MEMDGDPYNLPAQGQGNIIITKYEQGHRAGAAVDLGHEQVDVRKYTNNLGIV

SEQ ID NO: 87098 - protein, 66 aa, Homo sapiens
  Payload ID: 17428
  Gene Symbol: TBC1D26
  Gene Name: TBC1 domain family, member 26
  ENSP ID: ENSP00000463783
MEMDGDPYNLPAQGQGNIIITKYEQGHRAGAAVDLGHEQVDVRKYTNNLGIVHEMELPHVSALEVK

SEQ ID NO: 87099 - protein, 13 aa, Homo sapiens
  Payload ID: 17428
  Gene Symbol: TBC1D26
  Gene Name: TBC1 domain family, member 26
  ENSP ID: ENSP00000464068
MEMDGDPYNLPAQ

SEQ ID NO: 87100 - protein, 15 aa, Homo sapiens
  Payload ID: 17428
  Gene Symbol: TBC1D26
  Gene Name: TBC1 domain family, member 26
  ENSP ID: ENSP00000464236
MEMDGDPYNLPAQGQ

SEQ ID NO: 87101 - protein, 210 aa, Homo sapiens; identical to SEQ ID NO: 87096
  Payload ID: 17428
  Gene Symbol: TBC1D26
  Gene Name: TBC1 domain family, member 26
  Uniprot ID: Q86UD7
  ENSP ID: ENSP00000478643

SEQ ID NO: 87102 - protein, 210 aa, Homo sapiens
  Payload ID: 17429
  Gene Symbol: TBC1D28
  Gene Name: TBC1 domain family, member 28
  Uniprot ID: Q2M2D7
  ENSP ID: ENSP00000339973
MEMDEDPDNLPAQGQGNIIITKYEQGHRAGAAVDLGHEQVDVRKYTNNLGIVHEMELPRVSALEVKQRRKESKRTNKWQKMLADWTKYRSTKKLSQRVCKVIPLAVRGRALSLLLDIDKIKSQNPGKYKVMKEKGKRSSRIIHCIQLDVSHTLQKHMMFIQRFGVKQQELCDILVAYSAYNPVSIPGQRYSWYLCPYSQAWVSLGGVATS

SEQ ID NO: 87103 - protein, 210 aa, Homo sapiens; identical to SEQ ID NO: 87102
  Payload ID: 17429
  Gene Symbol: TBC1D28
  Gene Name: TBC1 domain family, member 28
  Uniprot ID: Q2M2D7
  ENSP ID: ENSP00000385821

SEQ ID NO: 87104 - protein, 65 aa, Homo sapiens
  Payload ID: 17429
  Gene Symbol: TBC1D28
  Gene Name: TBC1 domain family, member 28
  ENSP ID: ENSP00000458676
MEMDEDPDNLPAQGQGNIIITKYEQGHRAGAAVDLGHEQVDVRKYTNNLGIVHEMELPRVSALEV

SEQ ID NO: 87105 - protein, 13 aa, Homo sapiens
  Payload ID: 17429
  Gene Symbol: TBC1D28
  Gene Name: TBC1 domain family, member 28
  ENSP ID: ENSP00000460935
MEMDEDPDNLPAQ

SEQ ID NO: 87106 - protein, 52 aa, Homo sapiens
  Payload ID: 17429
  Gene Symbol: TBC1D28
  Gene Name: TBC1 domain family, member 28
  ENSP ID: ENSP00000461503
MEMDEDPDNLPAQGQGNIIITKYEQGHRAGAAVDLGHEQVDVRKYTNNLGIV

SEQ ID NO: 87107 - protein, 15 aa, Homo sapiens
  Payload ID: 17429
  Gene Symbol: TBC1D28
  Gene Name: TBC1 domain family, member 28
  ENSP ID: ENSP00000461684
MEMDEDPDNLPAQGQ

SEQ ID NO: 87108 - protein, 150 aa, Homo sapiens
  Payload ID: 17430
  Gene Symbol: TBC1D29
  Gene Name: TBC1 domain family, member 29
  Uniprot ID: Q9UFV1
  ENSP ID: ENSP00000462799
MGHLDKEGLCTQGSSFSWLLRVLNDGISLGLTPCLWDMYLLEGEQMLMLITSIAFKVQRSLYEETNKETWGPATPRALKGTGRARPICESLHSSLQALTASESSRGPSLLQTPPRVPGQQALSRGDKGISVSLSLPSLPSRRGRCGRIIG

SEQ ID NO: 87109 - protein, 81 aa, Homo sapiens
  Payload ID: 17430
  Gene Symbol: TBC1D29
  Gene Name: TBC1 domain family, member 29
  ENSP ID: ENSP00000463703
MGHLDKEGLCTQGSSFSWLLRVLNDGISLGLTPCLWDMYLLEGEQMLMLITSIAFKVQRRPSRALEEPDPFVRASTPPCKR

SEQ ID NO: 87110 - protein, 150 aa, Homo sapiens; identical to SEQ ID NO: 87108
  Payload ID: 17430
  Gene Symbol: TBC1D29
  Gene Name: TBC1 domain family, member 29
  Uniprot ID: Q9UFV1
  ENSP ID: ENSP00000464450

SEQ ID NO: 87111 - protein, 963 aa, Homo sapiens
  Payload ID: 17431
  Gene Symbol: TBC1D2B
  Gene Name: TBC1 domain family, member 2B
  Uniprot ID: Q9UPU7
  ENSP ID: ENSP00000300584
MPGAGARAEEGGGGGEGAAQGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDARKLISISFGDLNPFPLRQIRNRRAYHLEKVRLELTELEAIREDFLRERDTSPDKGELVSDEEEDT

SEQ ID NO: 87112 - protein, 914 aa, Homo sapiens
  Payload ID: 17431
  Gene Symbol: TBC1D2B
  Gene Name: TBC1 domain family, member 2B
  Uniprot ID: Q9UPU7
  ENSP ID: ENSP00000387165
MPGAGARAEEGGGGGEGAAQGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDARSGTDAPTTWRKSGWS

SEQ ID NO: 87113 - protein, 291 aa, Homo sapiens
  Payload ID: 17431
  Gene Symbol: TBC1D2B
  Gene Name: TBC1 domain family, member 2B
  ENSP ID: ENSP00000413666
MITTTKELAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDD

SEQ ID NO: 87114 - protein, 122 aa, Homo sapiens
  Payload ID: 17431
  Gene Symbol: TBC1D2B
  Gene Name: TBC1 domain family, member 2B
  ENSP ID: ENSP00000453114
  MOD_RES (1)..(1): Any amino acid
XCKIRCLYLSISATSLALSLMLGPACRSEQYTLCLCTPRGHGAQPGTGTQVPTAQDPKTLSLPEQHLTACVRMKADLHRHLLAVLLVLIHPLFSYVASPLAVPGGVAECGVLVGWVPRPSAS

SEQ ID NO: 87115 - protein, 549 aa, Homo sapiens
  Payload ID: 17432
  Gene Symbol: TBC1D3
  Gene Name: TBC1 domain family, member 3
  Uniprot ID: Q8IZP1
  ENSP ID: ENSP00000478683
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKKGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87116 - protein, 123 aa, Homo sapiens
  Payload ID: 17433
  Gene Symbol: TBC1D30
  Gene Name: TBC1 domain family, member 30
  ENSP ID: ENSP00000439897
MRQDKLTGSLRRGGRCLKRQGGGVGTILSNVLKKRSCISRTAPRLLCTLEPGVDTKLKFTLEPSLGQNGFQQWYDALKAVARLSTGIPKEWRRKDLHRTGCSSYCGQEAEQDRVVLKRVLLAY

SEQ ID NO: 87117 - protein, 761 aa, Homo sapiens
  Payload ID: 17433
  Gene Symbol: TBC1D30
  Gene Name: TBC1 domain family, member 30
  Uniprot ID: Q9Y2I9
  ENSP ID: ENSP00000440207
MRQDKLTGSLRRGGRCLKRQGGGVGTILSNVLKKRSCISRTAPRLLCTLEPGVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 87118 - protein, 647 aa, Homo sapiens
  Payload ID: 17433
  Gene Symbol: TBC1D30
  Gene Name: TBC1 domain family, member 30
  ENSP ID: ENSP00000440640
MRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 87119 - protein, 146 aa, Homo sapiens
  Payload ID: 17433
  Gene Symbol: TBC1D30
  Gene Name: TBC1 domain family, member 30
  ENSP ID: ENSP00000440787
MLYLRQKDANELKTILRELKYRIGIQSAKLLRHLKQKDRLLHKVQRNCDIVTACLQAVSQKRRVDTKLKFTLEPSLGQNGFQQWYDALKAVARLSTGIPKEWRRKVWLTLADHYLHSIAIDWDKTMRFTFNERSNPDDDSMGIQIV

SEQ ID NO: 87120 - protein, 91 aa, Homo sapiens
  Payload ID: 17433
  Gene Symbol: TBC1D30
  Gene Name: TBC1 domain family, member 30
  ENSP ID: ENSP00000442442
MRFTFNERSNPDDDSMGIQIVKDLHRTGCSSYCGQEAEQDRVVLKRVLLAYARWNKTVGYCQGFNILAALILEVMEGNEGDALKIMIYLID

SEQ ID NO: 87121 - protein, 1066 aa, Homo sapiens
  Payload ID: 17434
  Gene Symbol: TBC1D31
  Gene Name: TBC1 domain family, member 31
  Uniprot ID: Q96DN5
  ENSP ID: ENSP00000287380
MQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 87122 - protein, 970 aa, Homo sapiens
  Payload ID: 17434
  Gene Symbol: TBC1D31
  Gene Name: TBC1 domain family, member 31
  Uniprot ID: Q96DN5
  ENSP ID: ENSP00000312701
MQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKNLTENQEALAKEMRADADAYRRKVDLEEHMFHKLIEAGETQSQKTQKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 87123 - protein, 68 aa, Homo sapiens
  Payload ID: 17434
  Gene Symbol: TBC1D31
  Gene Name: TBC1 domain family, member 31
  ENSP ID: ENSP00000427848
MRGHESSVFSISVHASGKYAITTSSDTAQLWDLDTFQRKRKLNIRQSVGIQKVFFLPLSNTILSCFKD

SEQ ID NO: 87124 - protein, 44 aa, Homo sapiens
  Payload ID: 17434
  Gene Symbol: TBC1D31
  Gene Name: TBC1 domain family, member 31
  ENSP ID: ENSP00000428486
MFLTYMETVTKELVSWMRGHESSVFSISVHASGKYAITTSSDTA

SEQ ID NO: 87125 - protein, 247 aa, Homo sapiens
  Payload ID: 17434
  Gene Symbol: TBC1D31
  Gene Name: TBC1 domain family, member 31
  ENSP ID: ENSP00000428891
MEQNTLPVLWSLHIGVIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTK

SEQ ID NO: 87126 - protein, 961 aa, Homo sapiens
  Payload ID: 17434
  Gene Symbol: TBC1D31
  Gene Name: TBC1 domain family, member 31
  ENSP ID: ENSP00000429334
MFLTYMETVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 87127 - protein, 620 aa, Homo sapiens
  Payload ID: 17434
  Gene Symbol: TBC1D31
  Gene Name: TBC1 domain family, member 31
  ENSP ID: ENSP00000429494
MKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFETVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 87128 - protein, 943 aa, Homo sapiens
  Payload ID: 17434
  Gene Symbol: TBC1D31
  Gene Name: TBC1 domain family, member 31
  ENSP ID: ENSP00000430628
MFLTYMETVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 87129 - protein, 146 aa, Homo sapiens
  Payload ID: 17434
  Gene Symbol: TBC1D31
  Gene Name: TBC1 domain family, member 31
  ENSP ID: ENSP00000430927
MAPQAVPGHAGRPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQ

SEQ ID NO: 87130 - protein, 78 aa, Homo sapiens
  Payload ID: 17434
  Gene Symbol: TBC1D31
  Gene Name: TBC1 domain family, member 31
  ENSP ID: ENSP00000432064
  MOD_RES (1)..(1): Any amino acid
XLNKKRLQILLKGYGEYPTKYRMFIWRSLLQLPENHTAFSTLIDKGTHVAFLNLQKKYPIKSRKLLRVLQSQLVSTLV

SEQ ID NO: 87131 - protein, 155 aa, Homo sapiens
  Payload ID: 17434
  Gene Symbol: TBC1D31
  Gene Name: TBC1 domain family, member 31
  ENSP ID: ENSP00000432525
  MOD_RES (1)..(1): Any amino acid
XDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKEEVRAQN

SEQ ID NO: 87132 - protein, 80 aa, Homo sapiens
  Payload ID: 17434
  Gene Symbol: TBC1D31
  Gene Name: TBC1 domain family, member 31
  ENSP ID: ENSP00000440772
MQSTDLGNKESGKIWHRKPSPATRDGIIVNIIHNTSDYHPKVLRFLNVAFDGTGDCLIAGDHQGNIYVFDLHGNSHQGAS

SEQ ID NO: 87133 - protein, 1298 aa, Homo sapiens
  Payload ID: 17435
  Gene Symbol: TBC1D32
  Gene Name: TBC1 domain family, member 32
  Uniprot ID: Q96NH3
  ENSP ID: ENSP00000275159
MAHFSSEDQAMLQAMLRRLFQSVKEKITGAPSLECAEEILLHLEETDENFHNYEFVKYLRQHIGNTLGSMIEEEMEKCTSDRNQGEECGYDTVVQQVTKRTQESKEYKEMMHYLKNIMIAVVESMINKFEEDETRNQERQKKIQKEKSHSYRTDNCSDSDSSLNQSYKFCQGKLQLILDQLDPGQPKEVRYEALQTLCSAPPSDVLNCENWTTLCEKLTVSLSDPDPVFSDRILKFCAQTFLLSPLHMTKEIYTSLAKYLESYFLSRENHIPTLSAGVDITNPNMTRLLKKVRLLNEYQKEAPSFWIRHPEKYMEEIVESTLSLLTVKHNQSHVVSQKILDPIYFFALVDTKAVWFKKWMHAHYSRTTVLRLLETKYKSLVTTAIQQCVQYFEMCKTRKADETLGHSKHCRNKQKTFYYLGQELQYIYFIHSLCLLGRLLIYKQGRKLFPIKLKNKKGLVSLIDLLVLFTQLIYYSPSCPKMTSAAHSENYSPASMVTEVLWILSDQKECAVECLYNNIVIETLLQPIHNLMKGNEASPNCSETALIHIAGILARIASVEEGLILLLYGANMNSSEESPTGAHIIAQFSKKLLDEDISIFSGSEMLPVVKGAFISVCRHIYSTCEGLQVLITYNLHESIAKAWKKTSLLSERIPTPVEGSDSVSSVSQESQNIMAWEDNLLDDLLHFAATPKGLLLLQRTGAINECVTFIFNRYAKKLQVSRHKKFGYGVLVTRVASTAAGGIALKKSGFINELITELWSNLEYGRDDVRVTHPRTTPVDPIDRSCQKSFLALVNLLSYPAIYELVRNQDLPNKTEYSLREVPTCVIDIIDRLIILNSEAKIRSLFNYEQSHIFGLRLLSVICCDLDTLLLLEAQYQVSEMLLNAQEENILEISESHRDFIIDGLSVERNHVLVRINLVGGPLERILPPRLLEKSDNPYPWPMFSSYPLPNCYLSDITRNAGIKQDNDLDKLLLCLKISDKQTEWIENCQRQFCKMMKAKPDIISGEALIELLEKFVLHLTESPSECYFPSVEYTATDANVKNESLSSVQQLGIKMTVRYGKFLSLLKDGAENDLTWVLKHCERFLKQQQTSIKSSLLCLQGNYAGHDWFVSSLFMIMLGDKEKTFQFLHQFSRLLTSAFLWLPRLHISSYLPNDTVESGIHPVYFCSTHYIEMLLKAELPLVFSAFHMSGFAPSQICLQWITQCFWNYLDWIEICHYIATCVFLGPDYQVYICIAVFKHLQQDILQHTQTQDLQVFLKEEALHGFRVSDYFEYMEILEQNYRTVLLRDMRNIRLQST

SEQ ID NO: 87134 - protein, 1257 aa, Homo sapiens
  Payload ID: 17435
  Gene Symbol: TBC1D32
  Gene Name: TBC1 domain family, member 32
  Uniprot ID: Q96NH3
  ENSP ID: ENSP00000381270
MAHFSSEDQAMLQAMLRRLFQSVKEKITGAPSLECAEEILLHLEETDENFHNYEFVKYLRQHIGNTLGSMIEEEMEKCTSDRNQGEECGYDTVVQQVTKRTQESKEYKEMMHYLKNIMIAVVESMINKFEEDETRNQERQKKIQKEKSHSYRTDNCSDSDSSLNQSYKFCQGKLQLILDQLDPGQPKEVRYEALQTLCSAPPSDVLNCENWTTLCEKLTVSLSDPDPVFSDRILKFCAQTFLLSPLHMTKEIYTSLAKYLESYFLSRENHIPTLSAGVDITNPNMTRLLKKVRLLNEYQKEAPSFWIRHPEKYMEEIVESTLSLLTVKHNQSHVVSQKILDPIYFFALVDTKAVWFKKWMHAHYSRTTVLRLLETKYKSLVTTAIQQCVQYFEMCKTRKADETLGHSKHCRNKQKTFYYLGQELQYIYFIHSLCLLGRLLIYKQGRKLFPIKLKNKKGLVSLIDLLVLFTQLIYYSPSCPKMTSAAHSENYSPASMVTEVLWILSDQKECAVECLYNNIVIETLLQPIHNLMKGNEASPNCSETALIHIAGILARIASVEEGLILLLYGANMNSSEESPTGAHIIAQFSKKLLDEDISIFSGSEMLPVVKGAFISVCRHIYSTCEGLQVLITYNLHESIAKAWKKTSLLSERIPTPVEGSDSVSSVSQESQNIMAWEDNLLDDLLHFAATPKGLLLLQRTGAINECVTFIFNRYAKKLQVSRHKKFGYGVLVTRVASTAAGGIALKKSGFINELITELWSNLEYGRDDVRVTHPRTTPVDPIDRSCQKSFLALVNLLSYPAIYELVRNQDLPNKTEYSLREVPTCVIDIIDRLIILNSEAKIRSLFNYEQSHIFGLRDFIIDGLSVERNHVLVRINLVGGPLERILPPRLLEKSDNPYPWPMFSSYPLPNCYLSDITRNAGIKQDNDLDKLLLCLKISDKQTEWIENCQRQFCKMMKAKPDIISGEALIELLEKFVLHLTESPSECYFPSVEYTATDANVKNESLSSVQQLGIKMTVRYGKFLSLLKDGAENDLTWVLKHCERFLKQQQTSIKSSLLCLQGNYAGHDWFVSSLFMIMLGDKEKTFQFLHQFSRLLTSAFLWLPRLHISSYLPNDTVESGIHPVYFCSTHYIEMLLKAELPLVFSAFHMSGFAPSQICLQWITQCFWNYLDWIEICHYIATCVFLGPDYQVYICIAVFKHLQQDILQHTQTQDLQVFLKEEALHGFRVSDYFEYMEILEQNYRTVLLRDMRNIRLQST

SEQ ID NO: 87135 - protein, 213 aa, Homo sapiens
  Payload ID: 17435
  Gene Symbol: TBC1D32
  Gene Name: TBC1 domain family, member 32
  ENSP ID: ENSP00000397993
MAHFSSEDQAMLQAMLRRLFQSVKEKITGAPSLECAEEILLHLEETDENFHNYEFVKYLRQHIGNTLGSMIEEEMEKCTSDRNQGEECGYDTVVQQVTKRTQESKEYKEMMHYLKNIMIAVVESMINKFEEDETRNQERQKKIQKEKSHSYRTDNCSDSDSSLNQSYKFCQGKLQLILDQLDPGQPKEVRYEALQTLCSAPPSDVLNCENWTT

SEQ ID NO: 87136 - protein, 108 aa, Homo sapiens
  Payload ID: 17435
  Gene Symbol: TBC1D32
  Gene Name: TBC1 domain family, member 32
  Uniprot ID: Q96NH3
  ENSP ID: ENSP00000428839
MAHFSSEDQAMLQAMLRRLFQSVKEKITGAPSLECAEEILLHLEETDENFHNYEFVKYLRQHIGNTLGSMIEEEMEKCTSDRNQGEECGYDTVVQQVTKRTQESKELP

SEQ ID NO: 87137 - protein, 67 aa, Homo sapiens
  Payload ID: 17435
  Gene Symbol: TBC1D32
  Gene Name: TBC1 domain family, member 32
  ENSP ID: ENSP00000429928
ITRNAGIKQDNDLDKLLLCLKISDKQTEWIENCQRQFCKMMKAKPDIISGEVLPIFRFFLCEIPSRV

SEQ ID NO: 87138 - protein, 549 aa, Homo sapiens
  Payload ID: 17436
  Gene Symbol: TBC1D3B
  Gene Name: TBC1 domain family, member 3B
  ENSP ID: ENSP00000477537
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPAWFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87139 - protein, 49 aa, Homo sapiens
  Payload ID: 17436
  Gene Symbol: TBC1D3B
  Gene Name: TBC1 domain family, member 3B
  ENSP ID: ENSP00000478440
MLGDWEKYKSSRKLIDRAYKGMPMNIRGPMWSVLLNIEEMKLKNPGRYQ

SEQ ID NO: 87140 - protein, 549 aa, Homo sapiens
  Payload ID: 17436
  Gene Symbol: TBC1D3B
  Gene Name: TBC1 domain family, member 3B
  Uniprot ID: A6NDS4
  ENSP ID: ENSP00000478473
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGRKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87141 - protein, 549 aa, Homo sapiens; identical to SEQ ID NO: 87138
  Payload ID: 17436
  Gene Symbol: TBC1D3B
  Gene Name: TBC1 domain family, member 3B
  ENSP ID: ENSP00000478775

SEQ ID NO: 87142 - protein, 549 aa, Homo sapiens
  Payload ID: 17436
  Gene Symbol: TBC1D3B
  Gene Name: TBC1 domain family, member 3B
  ENSP ID: ENSP00000479135
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYFPEEDAFWALVQLLASERHSLQGFHSPNGGTVQGLQDQQEHVVATSQSKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQYAPTSGPCLCGLHLESSQFPPGF

SEQ ID NO: 87143 - protein, 115 aa, Homo sapiens
  Payload ID: 17436
  Gene Symbol: TBC1D3B
  Gene Name: TBC1 domain family, member 3B
  ENSP ID: ENSP00000479418
MDVVEVAGSWWAQEREDIIMKYEKGHRAGLPEDKGPKPFRSYNNNVDHLGIVQSGQPPFQGQNSSLTPLQVQPEVVRPEVWGPSREPVGMETGLGQAPGRSAVLSASEHKRSGAA

SEQ ID NO: 87144 - protein, 549 aa, Homo sapiens; identical to SEQ ID NO: 87140
  Payload ID: 17436
  Gene Symbol: TBC1D3B
  Gene Name: TBC1 domain family, member 3B
  Uniprot ID: A6NDS4
  ENSP ID: ENSP00000484556

SEQ ID NO: 87145 - protein, 115 aa, Homo sapiens; identical to SEQ ID NO: 87143
  Payload ID: 17436
  Gene Symbol: TBC1D3B
  Gene Name: TBC1 domain family, member 3B
  ENSP ID: ENSP00000487619

SEQ ID NO: 87146 - protein, 549 aa, Homo sapiens; identical to SEQ ID NO: 87142
  Payload ID: 17436
  Gene Symbol: TBC1D3B
  Gene Name: TBC1 domain family, member 3B
  ENSP ID: ENSP00000487654

SEQ ID NO: 87147 - protein, 49 aa, Homo sapiens; identical to SEQ ID NO: 87139
  Payload ID: 17436
  Gene Symbol: TBC1D3B
  Gene Name: TBC1 domain family, member 3B
  ENSP ID: ENSP00000487824

SEQ ID NO: 87148 - protein, 115 aa, Homo sapiens; identical to SEQ ID NO: 87143
  Payload ID: 17436
  Gene Symbol: TBC1D3B
  Gene Name: TBC1 domain family, member 3B
  ENSP ID: ENSP00000488156

SEQ ID NO: 87149 - protein, 49 aa, Homo sapiens; identical to SEQ ID NO: 87139
  Payload ID: 17436
  Gene Symbol: TBC1D3B
  Gene Name: TBC1 domain family, member 3B
  ENSP ID: ENSP00000488670

SEQ ID NO: 87150 - protein, 549 aa, Homo sapiens
  Payload ID: 17437
  Gene Symbol: TBC1D3C
  Gene Name: TBC1 domain family, member 3C
  ENSP ID: ENSP00000480107
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLQPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 87151 - protein, 549 aa, Homo sapiens; identical to SEQ ID NO: 87115
  Payload ID: 17437
  Gene Symbol: TBC1D3C
  Gene Name: TBC1 domain family, member 3C
  Uniprot ID: Q6IPX1
  ENSP ID: ENSP00000482345

SEQ ID NO: 87152 - protein, 549 aa, Homo sapiens
  Payload ID: 17438
  Gene Symbol: TBC1D3D
  Gene Name: TBC1 domain family, member 3D
  Uniprot ID: A0A087WVF3
  ENSP ID: ENSP00000478426
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87153 - protein, 549 aa, Homo sapiens; identical to SEQ ID NO: 87152
  Payload ID: 17438
  Gene Symbol: TBC1D3D
  Gene Name: TBC1 domain family, member 3D
  Uniprot ID: A0A087WVF3
  ENSP ID: ENSP00000479402

SEQ ID NO: 87154 - protein, 549 aa, Homo sapiens
  Payload ID: 17439
  Gene Symbol: TBC1D3E
  Gene Name: TBC1 domain family, member 3E
  Uniprot ID: A0A087X179
  ENSP ID: ENSP00000483965
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDQAYKGMPMNIRGPMWSVLLNTEEMKLKNPGRYQIMKEKGKKSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKKGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87155 - protein, 549 aa, Homo sapiens; identical to SEQ ID NO: 87115
  Payload ID: 17439
  Gene Symbol: TBC1D3E
  Gene Name: TBC1 domain family, member 3E
  ENSP ID: ENSP00000483991

SEQ ID NO: 87156 - protein, 495 aa, Homo sapiens
  Payload ID: 17440
  Gene Symbol: TBC1D3F
  Gene Name: TBC1 domain family, member 3F
  ENSP ID: ENSP00000477679
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKKGDVPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQA

SEQ ID NO: 87157 - protein, 549 aa, Homo sapiens
  Payload ID: 17440
  Gene Symbol: TBC1D3F
  Gene Name: TBC1 domain family, member 3F
  Uniprot ID: A6NER0
  ENSP ID: ENSP00000477822
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKKGDVPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87158 - protein, 549 aa, Homo sapiens
  Payload ID: 17440
  Gene Symbol: TBC1D3F
  Gene Name: TBC1 domain family, member 3F
  ENSP ID: ENSP00000479401
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87159 - protein, 495 aa, Homo sapiens; identical to SEQ ID NO: 87156
  Payload ID: 17440
  Gene Symbol: TBC1D3F
  Gene Name: TBC1 domain family, member 3F
  ENSP ID: ENSP00000487737

SEQ ID NO: 87160 - protein, 549 aa, Homo sapiens
  Payload ID: 17441
  Gene Symbol: TBC1D3G
  Gene Name: TBC1 domain family, member 3G
  Uniprot ID: Q6DHY5
  ENSP ID: ENSP00000456861
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87161 - protein, 549 aa, Homo sapiens; identical to SEQ ID NO: 87160
  Payload ID: 17441
  Gene Symbol: TBC1D3G
  Gene Name: TBC1 domain family, member 3G
  Uniprot ID: Q6DHY5
  ENSP ID: ENSP00000482403

SEQ ID NO: 87162 - protein, 549 aa, Homo sapiens
  Payload ID: 17442
  Gene Symbol: TBC1D3H
  Gene Name: TBC1 domain family, member 3H
  Uniprot ID: P0C7X1
  ENSP ID: ENSP00000480874
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDISGTLRKHMFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87163 - protein, 549 aa, Homo sapiens; identical to SEQ ID NO: 87158
  Payload ID: 17442
  Gene Symbol: TBC1D3H
  Gene Name: TBC1 domain family, member 3H
  ENSP ID: ENSP00000481284

SEQ ID NO: 87164 - protein, 549 aa, Homo sapiens; identical to SEQ ID NO: 87162
  Payload ID: 17442
  Gene Symbol: TBC1D3H
  Gene Name: TBC1 domain family, member 3H
  Uniprot ID: P0C7X1
  ENSP ID: ENSP00000481632

SEQ ID NO: 87165 - protein, 549 aa, Homo sapiens; identical to SEQ ID NO: 87162
  Payload ID: 17442
  Gene Symbol: TBC1D3H
  Gene Name: TBC1 domain family, member 3H
  Uniprot ID: P0C7X1
  ENSP ID: ENSP00000482630

SEQ ID NO: 87166 - protein, 549 aa, Homo sapiens
  Payload ID: 17443
  Gene Symbol: TBC1D3I
  Gene Name: TBC1 domain family, member 3I
  ENSP ID: ENSP00000478225
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKMKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87167 - protein, 549 aa, Homo sapiens; identical to SEQ ID NO: 87166
  Payload ID: 17443
  Gene Symbol: TBC1D3I
  Gene Name: TBC1 domain family, member 3I
  ENSP ID: ENSP00000478802

SEQ ID NO: 87168 - protein, 291 aa, Homo sapiens
  Payload ID: 17443
  Gene Symbol: TBC1D3I
  Gene Name: TBC1 domain family, member 3I
  ENSP ID: ENSP00000479137
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKMKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQSASRRRPGVARGHVFATGSLIPGPGMRTLCSSILGPL

SEQ ID NO: 87169 - protein, 291 aa, Homo sapiens; identical to SEQ ID NO: 87168
  Payload ID: 17443
  Gene Symbol: TBC1D3I
  Gene Name: TBC1 domain family, member 3I
  ENSP ID: ENSP00000479474

SEQ ID NO: 87170 - protein, 291 aa, Homo sapiens; identical to SEQ ID NO: 87168
  Payload ID: 17443
  Gene Symbol: TBC1D3I
  Gene Name: TBC1 domain family, member 3I
  ENSP ID: ENSP00000480410

SEQ ID NO: 87171 - protein, 291 aa, Homo sapiens; identical to SEQ ID NO: 87168
  Payload ID: 17443
  Gene Symbol: TBC1D3I
  Gene Name: TBC1 domain family, member 3I
  ENSP ID: ENSP00000480473

SEQ ID NO: 87172 - protein, 549 aa, Homo sapiens; identical to SEQ ID NO: 87166
  Payload ID: 17443
  Gene Symbol: TBC1D3I
  Gene Name: TBC1 domain family, member 3I
  Uniprot ID: A0A087WXS9
  ENSP ID: ENSP00000481258

SEQ ID NO: 87173 - protein, 291 aa, Homo sapiens; identical to SEQ ID NO: 87168
  Payload ID: 17443
  Gene Symbol: TBC1D3I
  Gene Name: TBC1 domain family, member 3I
  ENSP ID: ENSP00000482914

SEQ ID NO: 87174 - protein, 549 aa, Homo sapiens; identical to SEQ ID NO: 87160
  Payload ID: 17443
  Gene Symbol: TBC1D3I
  Gene Name: TBC1 domain family, member 3I
  ENSP ID: ENSP00000484223

SEQ ID NO: 87175 - protein, 291 aa, Homo sapiens; identical to SEQ ID NO: 87168
  Payload ID: 17443
  Gene Symbol: TBC1D3I
  Gene Name: TBC1 domain family, member 3I
  ENSP ID: ENSP00000487662

SEQ ID NO: 87176 - protein, 549 aa, Homo sapiens
  Payload ID: 17444
  Gene Symbol: TBC1D3K
  Gene Name: TBC1 domain family, member 3K
  Uniprot ID: A0A087X1G2
  ENSP ID: ENSP00000484181
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKKSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKKGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQCAPTSGPCLCGLHLESSQFPPGF

SEQ ID NO: 87177 - protein, 549 aa, Homo sapiens
  Payload ID: 17444
  Gene Symbol: TBC1D3K
  Gene Name: TBC1 domain family, member 3K
  ENSP ID: ENSP00000484542
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 87178 - protein, 549 aa, Homo sapiens; identical to SEQ ID NO: 87150
  Payload ID: 17445
  Gene Symbol: TBC1D3L
  Gene Name: TBC1 domain family, member 3L
  Uniprot ID: B9A6J9
  ENSP ID: ENSP00000479577

SEQ ID NO: 87179 - protein, 549 aa, Homo sapiens; identical to SEQ ID NO: 87150
  Payload ID: 17445
  Gene Symbol: TBC1D3L
  Gene Name: TBC1 domain family, member 3L
  Uniprot ID: B9A6J9
  ENSP ID: ENSP00000480130

SEQ ID NO: 87180 - protein, 549 aa, Homo sapiens; identical to SEQ ID NO: 87150
  Payload ID: 17445
  Gene Symbol: TBC1D3L
  Gene Name: TBC1 domain family, member 3L
  Uniprot ID: B9A6J9
  ENSP ID: ENSP00000481508

SEQ ID NO: 87181 - protein, 549 aa, Homo sapiens
  Payload ID: 17445
  Gene Symbol: TBC1D3L
  Gene Name: TBC1 domain family, member 3L
  ENSP ID: ENSP00000482811
MDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNIEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 87182 - protein, 1235 aa, Homo sapiens
  Payload ID: 17446
  Gene Symbol: TBC1D4
  Gene Name: TBC1 domain family, member 4
  Uniprot ID: O60343
  ENSP ID: ENSP00000366852
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 87183 - protein, 1298 aa, Homo sapiens
  Payload ID: 17446
  Gene Symbol: TBC1D4
  Gene Name: TBC1 domain family, member 4
  Uniprot ID: O60343
  ENSP ID: ENSP00000366863
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEIRQDTASESSDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 87184 - protein, 1290 aa, Homo sapiens
  Payload ID: 17446
  Gene Symbol: TBC1D4
  Gene Name: TBC1 domain family, member 4
  Uniprot ID: O60343
  ENSP ID: ENSP00000395986
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEISDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 87185 - protein, 282 aa, Homo sapiens
  Payload ID: 17446
  Gene Symbol: TBC1D4
  Gene Name: TBC1 domain family, member 4
  ENSP ID: ENSP00000396932
DNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVVFLSGEDDPEKIEER

SEQ ID NO: 87186 - protein, 795 aa, Homo sapiens
  Payload ID: 17447
  Gene Symbol: TBC1D5
  Gene Name: TBC1 domain family, member 5
  Uniprot ID: Q92609
  ENSP ID: ENSP00000253692
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 87187 - protein, 142 aa, Homo sapiens
  Payload ID: 17447
  Gene Symbol: TBC1D5
  Gene Name: TBC1 domain family, member 5
  ENSP ID: ENSP00000387395
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPL

SEQ ID NO: 87188 - protein, 110 aa, Homo sapiens
  Payload ID: 17447
  Gene Symbol: TBC1D5
  Gene Name: TBC1 domain family, member 5
  ENSP ID: ENSP00000393882
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIE

SEQ ID NO: 87189 - protein, 183 aa, Homo sapiens
  Payload ID: 17447
  Gene Symbol: TBC1D5
  Gene Name: TBC1 domain family, member 5
  ENSP ID: ENSP00000396239
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVR

SEQ ID NO: 87190 - protein, 32 aa, Homo sapiens
  Payload ID: 17447
  Gene Symbol: TBC1D5
  Gene Name: TBC1 domain family, member 5
  ENSP ID: ENSP00000396850
MYHSLSETRHPLQPEEQEVGIDPLSSYSNKSG

SEQ ID NO: 87191 - protein, 795 aa, Homo sapiens; identical to SEQ ID NO: 87186
  Payload ID: 17447
  Gene Symbol: TBC1D5
  Gene Name: TBC1 domain family, member 5
  Uniprot ID: Q92609
  ENSP ID: ENSP00000398127

SEQ ID NO: 87192 - protein, 140 aa, Homo sapiens
  Payload ID: 17447
  Gene Symbol: TBC1D5
  Gene Name: TBC1 domain family, member 5
  ENSP ID: ENSP00000399967
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINN

SEQ ID NO: 87193 - protein, 817 aa, Homo sapiens
  Payload ID: 17447
  Gene Symbol: TBC1D5
  Gene Name: TBC1 domain family, member 5
  Uniprot ID: Q92609
  ENSP ID: ENSP00000402935
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGDVVTGSDAQVSVPVQTLTDLQGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 87194 - protein, 40 aa, Homo sapiens
  Payload ID: 17447
  Gene Symbol: TBC1D5
  Gene Name: TBC1 domain family, member 5
  ENSP ID: ENSP00000405886
MYHSLSETRHPLQPEEQEVGIDPLSSYSNKSGGKNGKNYL

SEQ ID NO: 87195 - protein, 30 aa, Homo sapiens
  Payload ID: 17447
  Gene Symbol: TBC1D5
  Gene Name: TBC1 domain family, member 5
  ENSP ID: ENSP00000408603
MYHSLSETRHPLQPEEQEVGIDPLSSYSNK

SEQ ID NO: 87196 - protein, 129 aa, Homo sapiens
  Payload ID: 17447
  Gene Symbol: TBC1D5
  Gene Name: TBC1 domain family, member 5
  ENSP ID: ENSP00000410596
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRK

SEQ ID NO: 87197 - protein, 40 aa, Homo sapiens; identical to SEQ ID NO: 87194
  Payload ID: 17447
  Gene Symbol: TBC1D5
  Gene Name: TBC1 domain family, member 5
  ENSP ID: ENSP00000411780

SEQ ID NO: 87198 - protein, 593 aa, Homo sapiens
  Payload ID: 17447
  Gene Symbol: TBC1D5
  Gene Name: TBC1 domain family, member 5
  ENSP ID: ENSP00000411925
MLWFLSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGDVVTGSDAQVSVPVQTLTDLQGLSSKNISSSPSVESLPGGREFTGSPPSSATKKDSFFSNISRSRSHSKTMGRKESEEELEAQISFLQGQLNDLDAMCKYCAKVMDTHLGK

SEQ ID NO: 87199 - protein, 74 aa, Homo sapiens
  Payload ID: 17447
  Gene Symbol: TBC1D5
  Gene Name: TBC1 domain family, member 5
  ENSP ID: ENSP00000414159
MYHSLSETRHPLQPEEQEVGIDPLSSYSNKSGGDSNKNGRRTSSTLDSEGTFNSYRKEWEELFVNNNYLATIRQ

SEQ ID NO: 87200 - protein, 40 aa, Homo sapiens; identical to SEQ ID NO: 87194
  Payload ID: 17447
  Gene Symbol: TBC1D5
  Gene Name: TBC1 domain family, member 5
  ENSP ID: ENSP00000414250

SEQ ID NO: 87201 - protein, 79 aa, Homo sapiens
  Payload ID: 17447
  Gene Symbol: TBC1D5
  Gene Name: TBC1 domain family, member 5
  ENSP ID: ENSP00000415379
MYHSLSETRHPLQPEEQEVGIDPLSSYSNKSGGDSNKNGRRTSSTLDSEGTFNSYRKEWEELFVNNNYLATIRQKGING

SEQ ID NO: 87202 - protein, 88 aa, Homo sapiens
  Payload ID: 17447
  Gene Symbol: TBC1D5
  Gene Name: TBC1 domain family, member 5
  ENSP ID: ENSP00000424998
MYHSLSETRHPLQPEEQEVGIDPLSSYSNKSGGDSNKNGRRTSSTLDSEGTFNSYRKEWEELFVNNNYLATIRQKGINGQLRSSRFRS

SEQ ID NO: 87203 - protein, 247 aa, Homo sapiens
  Payload ID: 17448
  Gene Symbol: TBC1D7
  Gene Name: TBC1 domain family, member 7
  Uniprot ID: Q9P0N9
  ENSP ID: ENSP00000343100
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 87204 - protein, 293 aa, Homo sapiens
  Payload ID: 17448
  Gene Symbol: TBC1D7
  Gene Name: TBC1 domain family, member 7
  Uniprot ID: Q9P0N9
  ENSP ID: ENSP00000348813
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 87205 - protein, 130 aa, Homo sapiens
  Payload ID: 17448
  Gene Symbol: TBC1D7
  Gene Name: TBC1 domain family, member 7
  ENSP ID: ENSP00000368593
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPD

SEQ ID NO: 87206 - protein, 293 aa, Homo sapiens; identical to SEQ ID NO: 87204
  Payload ID: 17448
  Gene Symbol: TBC1D7
  Gene Name: TBC1 domain family, member 7
  Uniprot ID: Q9P0N9
  ENSP ID: ENSP00000368602

SEQ ID NO: 87207 - protein, 266 aa, Homo sapiens
  Payload ID: 17448
  Gene Symbol: TBC1D7
  Gene Name: TBC1 domain family, member 7
  Uniprot ID: Q9P0N9
  ENSP ID: ENSP00000368609
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 87208 - protein, 249 aa, Homo sapiens
  Payload ID: 17448
  Gene Symbol: TBC1D7
  Gene Name: TBC1 domain family, member 7
  ENSP ID: ENSP00000394425
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIK

SEQ ID NO: 87209 - protein, 136 aa, Homo sapiens
  Payload ID: 17448
  Gene Symbol: TBC1D7
  Gene Name: TBC1 domain family, member 7
  ENSP ID: ENSP00000401339
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLA

SEQ ID NO: 87210 - protein, 179 aa, Homo sapiens
  Payload ID: 17448
  Gene Symbol: TBC1D7
  Gene Name: TBC1 domain family, member 7
  ENSP ID: ENSP00000401438
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLEGINVG

SEQ ID NO: 87211 - protein, 238 aa, Homo sapiens
  Payload ID: 17448
  Gene Symbol: TBC1D7
  Gene Name: TBC1 domain family, member 7
  ENSP ID: ENSP00000404680
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLEN

SEQ ID NO: 87212 - protein, 194 aa, Homo sapiens
  Payload ID: 17448
  Gene Symbol: TBC1D7
  Gene Name: TBC1 domain family, member 7
  ENSP ID: ENSP00000412102
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQ

SEQ ID NO: 87213 - protein, 156 aa, Homo sapiens
  Payload ID: 17448
  Gene Symbol: TBC1D7
  Gene Name: TBC1 domain family, member 7
  ENSP ID: ENSP00000414101
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLAIAKAMEEMVEDSVDCYWITR

SEQ ID NO: 87214 - protein, 238 aa, Homo sapiens; identical to SEQ ID NO: 87211
  Payload ID: 17448
  Gene Symbol: TBC1D7
  Gene Name: TBC1 domain family, member 7
  ENSP ID: ENSP00000414292

SEQ ID NO: 87215 - protein, 207 aa, Homo sapiens
  Payload ID: 17448
  Gene Symbol: TBC1D7
  Gene Name: TBC1 domain family, member 7
  ENSP ID: ENSP00000417005
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKI

SEQ ID NO: 87216 - protein, 199 aa, Homo sapiens
  Payload ID: 17448
  Gene Symbol: TBC1D7
  Gene Name: TBC1 domain family, member 7
  ENSP ID: ENSP00000475191
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRQGLG

SEQ ID NO: 87217 - protein, 164 aa, Homo sapiens
  Payload ID: 17448
  Gene Symbol: TBC1D7
  Gene Name: TBC1 domain family, member 7
  ENSP ID: ENSP00000475355
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLVSGHFCLTLSSTLDRPILPAFDYIMFCLKNFWWLPVVIRIKVTHLYLAFMAMHILTQPSYFLFF

SEQ ID NO: 87218 - protein, 20 aa, Homo sapiens
  Payload ID: 17448
  Gene Symbol: TBC1D7
  Gene Name: TBC1 domain family, member 7
  ENSP ID: ENSP00000475469
MTEDSQRNFRSVYYEKVGFR

SEQ ID NO: 87219 - protein, 293 aa, Homo sapiens; identical to SEQ ID NO: 87204
  Payload ID: 17448
  Gene Symbol: TBC1D7
  Gene Name: TBC1 domain family, member 7
  Uniprot ID: Q9P0N9
  ENSP ID: ENSP00000475727

SEQ ID NO: 87220 - protein, 152 aa, Homo sapiens
  Payload ID: 17448
  Gene Symbol: TBC1D7
  Gene Name: TBC1 domain family, member 7
  ENSP ID: ENSP00000475795
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLVSGHFCLTLSSTLDRPILPAFDYIM

SEQ ID NO: 87221 - protein, 87 aa, Homo sapiens
  Payload ID: 17448
  Gene Symbol: TBC1D7
  Gene Name: TBC1 domain family, member 7
  ENSP ID: ENSP00000476109
MTEDSQRNFRSVYYEKVGFRGVEEKKSLEILLKDDRLDTEKLCTFSQRFPLPSMYRALVWKVLLGLEKPAALSGYVIWRQRGNISGT

SEQ ID NO: 87222 - protein, 1140 aa, Homo sapiens
  Payload ID: 17449
  Gene Symbol: TBC1D8
  Gene Name: TBC1 domain family, member 8 (with GRAM domain)
  Uniprot ID: O95759
  ENSP ID: ENSP00000366036
MWLKPEEVLLKNALKLWVTQKSSCYFILQRRRGHGEGGGRLTGRLVGALDAVLDSNARVAPFRILLQVPGSQVYSPIACGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTTGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAERDWTVSLEHILASLLTEQSLVNFFEKPLDMKSKLENAKINQYNLKTFEMSHQSQSELKLSNL

SEQ ID NO: 87223 - protein, 1155 aa, Homo sapiens
  Payload ID: 17449
  Gene Symbol: TBC1D8
  Gene Name: TBC1 domain family, member 8 (with GRAM domain)
  ENSP ID: ENSP00000386856
MWLKPEEVLLKNALKLWVTQKSSCYFILQRRRGHGEGGGRLTGRLVGALDAVLDSNARVAPFRILLQVPGSQVYSPIACGELLNGSDVYWAIATGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTTGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAERDWTVSLEHILASLLTEQSLVNFFEKPLDMKSKLENAKINQYNLKTFEMSHQSQSELKLSNL

SEQ ID NO: 87224 - protein, 1114 aa, Homo sapiens
  Payload ID: 17450
  Gene Symbol: TBC1D8B
  Gene Name: TBC1 domain family, member 8B (with GRAM domain)
  ENSP ID: ENSP00000276175
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTESTEPSDNFEVQSLTSQRECSKTVNTEALMTVFHPQNLETLNSKMLKEKMKEQSWKILFAECGRGVSMFRTKKTRDLVVRGIPETLRGELWMLFSGAVNDMATNPDYYTEVVEQSLGTCNLATEEIERDLRRSLPEHPAFQSDTGISALRRVLTAYAYRNPKIGYCQAMNILTSVLLLYAKEEEAFWLLVAVCERMLPDYFNRRIIGALVDQAVFEELIRDHLPQLTEHMTDMTFFSSVSLSWFLTLFISVLPIESAVNVVDCFFYDGIKAILQLGLAILDYNLDKLLTCKDDAEAVTALNRFFDNVTNKDSPLPSNVQQGSNVSDEKTSHTRVDITDLIRESNEKYGNIRYEDIHSMRCRNRLYVIQTLEETTKQNVLRVVSQDVKLSLQELDELYVIFKKELFLSCYWCLGCPVLKHHDPSLPYLEQYQIDCQQFRALYHLLSPWAHSANKDSLALWTFRLLDENSDCLINFKEFSSAIDIMYNGSFTEKLKLLFKLHIPPAYTEVKSKDASKGDELSKEELLYFSQLHVSKPANEKEAESAKHSPEKGKGKIDIQAYLSQWQDELFKKEENIKDLPRMNQSQFIQFSKTLYNLFHEDPEEESLYQAIAVVTSLLLRMEEVGRKLHSPTSSAKGFSGTVCGSGGPSEEKTGSHLEKDPCSFREEPQWSFAFEQILASLLNEPALVRFFEKPIDVKAKLENARISQLRSRTKM

SEQ ID NO: 87225 - protein, 632 aa, Homo sapiens
  Payload ID: 17450
  Gene Symbol: TBC1D8B
  Gene Name: TBC1 domain family, member 8B (with GRAM domain)
  Uniprot ID: Q0IIM8
  ENSP ID: ENSP00000310675
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTELAISSESTEPSDNFEVQSLTSQRECSKTVNTEALMTVFHPQNLETLNSKMLKEKMKEQSWKILFAECGRGVSMFRTKKTRDLVVRGIPETLRGELWMLFSGAVNDMATNPDYYTEVVEQSLGTCNLATEEIERDLRRSLPEHPAFQSDTGISALRRVLTAYAYRNPKIGYCQAMNILTSVLLLYAKEEEAFWLLVAVCERMLPDYFNRRIIGSDDFMPLVRIQGQCVIGEK

SEQ ID NO: 87226 - protein, 1120 aa, Homo sapiens
  Payload ID: 17450
  Gene Symbol: TBC1D8B
  Gene Name: TBC1 domain family, member 8B (with GRAM domain)
  Uniprot ID: Q0IIM8
  ENSP ID: ENSP00000349781
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTELAISSESTEPSDNFEVQSLTSQRECSKTVNTEALMTVFHPQNLETLNSKMLKEKMKEQSWKILFAECGRGVSMFRTKKTRDLVVRGIPETLRGELWMLFSGAVNDMATNPDYYTEVVEQSLGTCNLATEEIERDLRRSLPEHPAFQSDTGISALRRVLTAYAYRNPKIGYCQAMNILTSVLLLYAKEEEAFWLLVAVCERMLPDYFNRRIIGALVDQAVFEELIRDHLPQLTEHMTDMTFFSSVSLSWFLTLFISVLPIESAVNVVDCFFYDGIKAILQLGLAILDYNLDKLLTCKDDAEAVTALNRFFDNVTNKDSPLPSNVQQGSNVSDEKTSHTRVDITDLIRESNEKYGNIRYEDIHSMRCRNRLYVIQTLEETTKQNVLRVVSQDVKLSLQELDELYVIFKKELFLSCYWCLGCPVLKHHDPSLPYLEQYQIDCQQFRALYHLLSPWAHSANKDSLALWTFRLLDENSDCLINFKEFSSAIDIMYNGSFTEKLKLLFKLHIPPAYTEVKSKDASKGDELSKEELLYFSQLHVSKPANEKEAESAKHSPEKGKGKIDIQAYLSQWQDELFKKEENIKDLPRMNQSQFIQFSKTLYNLFHEDPEEESLYQAIAVVTSLLLRMEEVGRKLHSPTSSAKGFSGTVCGSGGPSEEKTGSHLEKDPCSFREEPQWSFAFEQILASLLNEPALVRFFEKPIDVKAKLENARISQLRSRTKM

SEQ ID NO: 87227 - protein, 218 aa, Homo sapiens
  Payload ID: 17450
  Gene Symbol: TBC1D8B
  Gene Name: TBC1 domain family, member 8B (with GRAM domain)
  ENSP ID: ENSP00000396440
  MOD_RES (1)..(1): Any amino acid
XFNRFFDNVTNKDSPLPSNVQQGSNVSDEKTSHTRVDITDLIRESNELRVVSQDVKLSLQELDELYVIFKKELFLSCYWCLGCPVLKHHDPSLPYLEQYQIDCQQFRALYHLLSPWAHSANKDSLALWTFRLLDENSDCLINFKEFSSAIDIMYNGSFTEKLKLLFKLHIPPAYTEVKSKDASKGDELSKEELLYFSQLHVSKPANEKEAESAKHSPE

SEQ ID NO: 87228 - protein, 419 aa, Homo sapiens
  Payload ID: 17450
  Gene Symbol: TBC1D8B
  Gene Name: TBC1 domain family, member 8B (with GRAM domain)
  ENSP ID: ENSP00000421375
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTEVINYTAIKSFGKKGVCLV

SEQ ID NO: 87229 - protein, 22 aa, Homo sapiens
  Payload ID: 17450
  Gene Symbol: TBC1D8B
  Gene Name: TBC1 domain family, member 8B (with GRAM domain)
  ENSP ID: ENSP00000422353
MKTLSVFDSNEDITNFVQGKIR

SEQ ID NO: 87230 - protein, 1266 aa, Homo sapiens
  Payload ID: 17451
  Gene Symbol: TBC1D9
  Gene Name: TBC1 domain family, member 9 (with GRAM domain)
  Uniprot ID: Q6ZT07
  ENSP ID: ENSP00000411197
MWVNPEEVLLANALWITERANPYFILQRRKGHAGDGGGGGGLAGLLVGTLDVVLDSSARVAPYRILYQTPDSLVYWTIACGGSRKEITEHWEWLEQNLLQTLSIFENENDITTFVRGKIQGIIAEYNKINDVKEDDDTEKFKEAIVKFHRLFGMPEEEKLVNYYSCSYWKGKVPRQGWMYLSINHLCFYSFLMGREAKLVIRWVDITQLEKNATLLLPDVIKVSTRSSEHFFSVFLNINETFKLMEQLANIAMRQLLDNEGFEQDRSLPKLKRKSPKKVSALKRDLDARAKSERYRALFRLPKDEKLDGHTDCTLWTPFNKMHILGQMFVSTNYICFTSKEENLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGAINEKATHPGYYEDLVEKSMGKYNLATEEIERDLHRSLPEHPAFQNEMGIAALRRVLTAYAFRNPNIGYCQAMNIVTSVLLLYAKEEEAFWLLVALCERMLPDYYNTRVVGALVDQGVFEELARDYVPQLYDCMQDLGVISTISLSWFLTLFLSVMPFESAVVVVDCFFYEGIKVIFQLALAVLDANVDKLLNCKDDGEAMTVLGRYLDSVTNKDSTLPPIPHLHSLLSDDVEPYPEVDIFRLIRTSYEKFGTIRADLIEQMRFKQRLKVIQTLEDTTKRNVVRTIVTETSFTIDELEELYALFKAEHLTSCYWGGSSNALDRHDPSLPYLEQYRIDFEQFKGMFALLFPWACGTHSDVLASRLFQLLDENGDSLINFREFVSGLSAACHGDLTEKLKLLYKMHVLPEPSSDQDEPDSAFEATQYFFEDITPECTHVVGLDSRSKQGADDGFVTVSLKPDKGKRANSQENRNYLRLWTPENKSKSKNAKDLPKLNQGQFIELCKTMYNMFSEDPNEQELYHATAAVTSLLLEIGEVGKLFVAQPAKEGGSGGSGPSCHQGIPGVLFPKKGPGQPYVVESVEPLPASLAPDSEEHSLGGQMEDIKLEDSSPRDNGACSSMLISDDDTKDDSSMSSYSVLSAGSHEEDKLHCEDIGEDTVLVRSGQGTAALPRSTSLDRDWAITFEQFLASLLTEPALVKYFDKPVCMMARITSAKNIRMMGKPLTSASDYEISAMSG

SEQ ID NO: 87231 - protein, 1233 aa, Homo sapiens
  Payload ID: 17452
  Gene Symbol: TBC1D9B
  Gene Name: TBC1 domain family, member 9B (with GRAM domain)
  Uniprot ID: Q66K14
  ENSP ID: ENSP00000347375
MWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGKAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 87232 - protein, 1250 aa, Homo sapiens
  Payload ID: 17452
  Gene Symbol: TBC1D9B
  Gene Name: TBC1 domain family, member 9B (with GRAM domain)
  Uniprot ID: Q66K14
  ENSP ID: ENSP00000349291
MWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEASPLASDLDLFLPWEAQEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGKAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 87233 - protein, 166 aa, Homo sapiens
  Payload ID: 17452
  Gene Symbol: TBC1D9B
  Gene Name: TBC1 domain family, member 9B (with GRAM domain)
  ENSP ID: ENSP00000428441
  MOD_RES (1)..(1): Any amino acid
XAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQVCQVRWRRRTCWCKLGRS

SEQ ID NO: 87234 - protein, 65 aa, Homo sapiens
  Payload ID: 17452
  Gene Symbol: TBC1D9B
  Gene Name: TBC1 domain family, member 9B (with GRAM domain)
  ENSP ID: ENSP00000428724
  MOD_RES (1)..(1): Any amino acid
XRNISALKRDLDARAKNECYRATFRLPRDERLDGHTSCTLWTPFNKLHIPGQMFISNNYICFATR

SEQ ID NO: 87235 - protein, 100 aa, Homo sapiens
  Payload ID: 17452
  Gene Symbol: TBC1D9B
  Gene Name: TBC1 domain family, member 9B (with GRAM domain)
  ENSP ID: ENSP00000429361
MWLSPEEVLVANALWVTERANPFFVLQRRRGHGRGGGLTGLLVGTLDVVLDSSARVAPYRILHQTQDSQVYWTVACGNHRRREQEPAAPGRRGPREVQGG

SEQ ID NO: 87236 - protein, 409 aa, Homo sapiens
  Payload ID: 17452
  Gene Symbol: TBC1D9B
  Gene Name: TBC1 domain family, member 9B (with GRAM domain)
  ENSP ID: ENSP00000430293
MVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGKAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 87237 - protein, 100 aa, Homo sapiens; identical to SEQ ID NO: 87235
  Payload ID: 17452
  Gene Symbol: TBC1D9B
  Gene Name: TBC1 domain family, member 9B (with GRAM domain)
  ENSP ID: ENSP00000486765

SEQ ID NO: 87238 - protein, 557 aa, Homo sapiens
  Payload ID: 17453
  Gene Symbol: TBCCD1
  Gene Name: TBCC domain containing 1
  Uniprot ID: Q9NVR7
  ENSP ID: ENSP00000341652
MDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKIYPLHELALWQPLHADSGFSKISKTFSFYKLETWLRSCLTGNPFGTSACLKSGKKLAWAHQVEGTTKRAKIACNTHVAPRMHRLVVMSQVYKQTLAKSSDTLAGAHVKIHRCNESFIYLLSPLRSVTIEKCRNSIFVLGPVGTTLHLHSCDNVKVIAVCHRLSISSTTGCIFHVLTPTRPLILSGNQTVTFAPFHTHYPMLEDHMARTGLATVPNYWDNPMVVCRENSDTRVFQLLPPCEFYVFIIPFEMEGDTTEIPGGLPSVYQKALGQREQKIQIWQKTVKEAHLTKDQRKQFQVLVENKFYEWLINTGHRQQLDSLVPPAAGSKQAAG

SEQ ID NO: 87239 - protein, 226 aa, Homo sapiens
  Payload ID: 17453
  Gene Symbol: TBCCD1
  Gene Name: TBCC domain containing 1
  ENSP ID: ENSP00000391109
MDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKI

SEQ ID NO: 87240 - protein, 461 aa, Homo sapiens
  Payload ID: 17453
  Gene Symbol: TBCCD1
  Gene Name: TBCC domain containing 1
  Uniprot ID: Q9NVR7
  ENSP ID: ENSP00000397091
MTDRLKFGFGFHRFLVLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKIYPLHELALWQPLHADSGFSKISKTFSFYKLETWLRSCLTGNPFGTSACLKSGKKLAWAHQVEGTTKRAKIACNTHVAPRMHRLVVMSQVYKQTLAKSSDTLAGAHVKIHRCNESFIYLLSPLRSVTIEKCRNSIFVLGPVGTTLHLHSCDNVKVIAVCHRLSISSTTGCIFHVLTPTRPLILSGNQTVTFAPFHTHYPMLEDHMARTGLATVPNYWDNPMVVCRENSDTRVFQLLPPCEFYVFIIPFEMEGDTTEIPGGLPSVYQKALGQREQKIQIWQKTVKEAHLTKDQRKQFQVLVENKFYEWLINTGHRQQLDSLVPPAAGSKQAAG

SEQ ID NO: 87241 - protein, 148 aa, Homo sapiens
  Payload ID: 17453
  Gene Symbol: TBCCD1
  Gene Name: TBCC domain containing 1
  ENSP ID: ENSP00000407506
MDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLNKVSLRTSLIGEEWPSPRNKSQSPDLTEKSNCHNK

SEQ ID NO: 87242 - protein, 557 aa, Homo sapiens; identical to SEQ ID NO: 87238
  Payload ID: 17453
  Gene Symbol: TBCCD1
  Gene Name: TBCC domain containing 1
  Uniprot ID: Q9NVR7
  ENSP ID: ENSP00000411253

SEQ ID NO: 87243 - protein, 615 aa, Homo sapiens
  Payload ID: 17454
  Gene Symbol: TBKBP1
  Gene Name: TBK1 binding protein 1
  Uniprot ID: A7MCY6
  ENSP ID: ENSP00000354777
MESMFEDDISILTQEALGPSEVWLDSPGDPSLGGDMCSASHFALITAYGDIKERLGGLERENATLRRRLKVYEIKYPLISDFGEEHGFSLYEIKDGSLLEVEKVSLQQRLNQFQHELQKNKEQEEQLGEMIQAYEKLCVEKSDLETELREMRALVETHLRQICGLEQQLRQQQGLQDAAFSNLSPPPAPAPPCTDLDLHYLALRGGSGLSHAGWPGSTPSVSDLERRRLEEALEAAQGEARGAQLREEQLQAECERLQGELKQLQETRAQDLASNQSERDMAWVKRVGDDQVNLALAYTELTEELGRLRELSSLQGRILRTLLQEQARSGGQRHSPLSQRHSPAPQCPSPSPPARAAPPCPPCQSPVPQRRSPVPPCPSPQQRRSPASPSCPSPVPQRRSPVPPSCQSPSPQRRSPVPPSCPAPQPRPPPPPPPGERTLAERAYAKPPSHHVKAGFQGRRSYSELAEGAAYAGASPPWLQAEAATLPKPRAYGSELYGPGRPLSPRRAFEGIRLRFEKQPSEEDEWAVPTSPPSPEVGTIRCASFCAGFPIPESPAATAYAHAEHAQSWPSINLLMETVGSDIRSCPLCQLGFPVGYPDDALIKHIDSHLENSKI

SEQ ID NO: 87244 - protein, 208 aa, Homo sapiens
  Payload ID: 17454
  Gene Symbol: TBKBP1
  Gene Name: TBK1 binding protein 1
  ENSP ID: ENSP00000446365
MESMFEDDISILTQEALGPSEVWLDSPGDPSLGGDMCSASHFALITAYGDIKERLGGLERENATLRRRLKVYEIKYPLISDFGEEHGFSLYEIKDGSLLEVEKVSLQQRLNQFQHELQKNKEQEEQLGEMIQAYEKLCVEKSDLETELREMRALVETHLRQICGLEQQLRQQQGLQDAAFSNLSPPPAPAPPCTDLDLHYLALRGGSG

SEQ ID NO: 87245 - protein, 195 aa, Homo sapiens
  Payload ID: 17454
  Gene Symbol: TBKBP1
  Gene Name: TBK1 binding protein 1
  ENSP ID: ENSP00000462339
MESMFEDDISILTQEALGPSEVWLDSPGDPSLGGDMCSASHFALITAYGDIKERLGGLERENATLRRRLKVYEIKYPLISDFGEEHGFSLYEIKDGSLLEVEKVSLQQRLNQFQHELQKNKEQEEQLGEMIQAYEKLCVEKSDLETELREMRALVETHLRQICGLEQQLRQQQGLQDAAFSNLSPPPAPAPPCTD

SEQ ID NO: 87246 - protein, 222 aa, Homo sapiens
  Payload ID: 17454
  Gene Symbol: TBKBP1
  Gene Name: TBK1 binding protein 1
  Uniprot ID: A7MCY6
  ENSP ID: ENSP00000484395
MESMFEDDISILTQEALGPSEVWLDSPGDPSLGGDMCSASHFALITAYGDIKERLGGLERENATLRRRLKVYEIKYPLISDFGEEHGFSLYEIKDGSLLEVEKVSLQQRLNQFQHELQKNKEQEEQLGEMIQAYEKLCVEKSDLETELREMRALVETHLRQICGLEQQLRQQQGLQDAAFSNLSPRRARAVLAVHQLADGDGGLRHPQLPPLPAGFPCRVPG

SEQ ID NO: 87247 - protein, 398 aa, Homo sapiens
  Payload ID: 17455
  Gene Symbol: TBX1
  Gene Name: T-box 1
  Uniprot ID: O43435
  ENSP ID: ENSP00000331176
MHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGGHVLKDKEVKAETSRNTPEREVELLRDAGGCVNLGLPCPAECQPFNTQGLVAGRTAGDRLC

SEQ ID NO: 87248 - protein, 495 aa, Homo sapiens
  Payload ID: 17455
  Gene Symbol: TBX1
  Gene Name: T-box 1
  Uniprot ID: O43435
  ENSP ID: ENSP00000331791
MHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKDAAEARREFQRDAGGPAVLGDPAHPPQLLARVLSPSLPGAGGAGGLVPLPGAPGGRPSPPNPELRLEAPGASEPLHHHPYKYPAAAYDHYLGAKSRPAPYPLPGLRGHGYHPHAHPHHHHHPVSPAAAAAAAAAAAAAAANMYSSAGAAPPGSYDYCPR

SEQ ID NO: 87249 - protein, 372 aa, Homo sapiens
  Payload ID: 17455
  Gene Symbol: TBX1
  Gene Name: T-box 1
  Uniprot ID: O43435
  ENSP ID: ENSP00000352483
MHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGLVTEGSGLQPGLLDVLLKPPSKKSESLRPPHCKDT

SEQ ID NO: 87250 - protein, 372 aa, Homo sapiens; identical to SEQ ID NO: 87249
  Payload ID: 17455
  Gene Symbol: TBX1
  Gene Name: T-box 1
  Uniprot ID: O43435
  ENSP ID: ENSP00000477982

SEQ ID NO: 87251 - protein, 385 aa, Homo sapiens
  Payload ID: 17456
  Gene Symbol: TBX10
  Gene Name: T-box 10
  Uniprot ID: O75333
  ENSP ID: ENSP00000335191
MAAFLSAGLGILAPSETYPLPTTSSGWEPRLGSPFPSGPCTSSTGAQAVAEPTGQGPKNPRVSRVTVQLEMKPLWEEFNQLGTEMIVTKAGRRMFPPFQVKILGMDSLADYALLMDFIPLDDKRYRYAFHSSAWLVAGKADPATPGRVHFHPDSPAKGAQWMRQIVSFDKLKLTNNLLDDNGHIILNSMHRYQPRFHVVFVDPRKDSERYAQENFKSFIFTETQFTAVTAYQNHRITQLKIASNPFAKGFRESDLDSWPVAPRPLLSVPARSHSSLSPCVLKGATDREKDPNKASASTSKTPAWLHHQLLPPPEVLLAPATYRPVTYQSLYSGAPSHLGIPRTRPAPYPLPNIRADRDQGGLPLPAGLGLLSPTVVCLGPGQDSQ

SEQ ID NO: 87252 - protein, 496 aa, Homo sapiens
  Payload ID: 17457
  Gene Symbol: TBX15
  Gene Name: T-box 15
  Uniprot ID: Q96SF7
  ENSP ID: ENSP00000207157
MSSMEEIQVELQCADLWKRFHDIGTEMIITKAGRRMFPAMRVKITGLDPHQQYYIAMDIVPVDNKRYRYVYHSSKWMVAGNADSPVPPRVYIHPDSLASGDTWMRQVVSFDKLKLTNNELDDQGHIILHSMHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQGGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 87253 - protein, 602 aa, Homo sapiens
  Payload ID: 17457
  Gene Symbol: TBX15
  Gene Name: T-box 15
  Uniprot ID: Q96SF7
  ENSP ID: ENSP00000358437
MSERRRSAVALSSRAHAFSVEALIGSNKKRKLRDWEEKGLDLSMEALSPAGPLGDTEDAAAHGLEPHPDSEQSTGSDSEVLTERTSCSFSTHTDLASGAAGPVPAAMSSMEEIQVELQCADLWKRFHDIGTEMIITKAGRRMFPAMRVKITGLDPHQQYYIAMDIVPVDNKRYRYVYHSSKWMVAGNADSPVPPRVYIHPDSLASGDTWMRQVVSFDKLKLTNNELDDQGHIILHSMHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQGGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 87254 - protein, 330 aa, Homo sapiens
  Payload ID: 17457
  Gene Symbol: TBX15
  Gene Name: T-box 15
  ENSP ID: ENSP00000398625
GRNRTGLEAIMETYAFWRPPVRTLTFEDFTTMQKQQASKKTSQGYTVNQHSSETDAIELYERRVWLMERRGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 87255 - protein, 607 aa, Homo sapiens
  Payload ID: 17458
  Gene Symbol: TBX18
  Gene Name: T-box 18
  Uniprot ID: O95935
  ENSP ID: ENSP00000358677
MAEKRRGSPCSMLSLKAHAFSVEALIGAEKQQQLQKKRRKLGAEEAAGAVDDGGCSRGGGAGEKGSSEGDEGAALPPPAGATSGPARSGADLERGAAGGCEDGFQQGASPLASPGGSPKGSPARSLARPGTPLPSPQAPRVDLQGAELWKRFHEIGTEMIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGFRDSGRNRMGLEALVESYAFWRPSLRTLTFEDIPGIPKQGNASSSTLLQGTGNGVPATHPHLLSGSSCSSPAFHLGPNTSQLCSLAPADYSACARSGLTLNRYSTSLAETYNRLTNQAGETFAPPRTPSYVGVSSSTSVNMSMGGTDGDTFSCPQTSLSMQISGMSPQLQYIMPSPSSNAFATNQTHQGSYNTFRLHSPCALYGYNFSTSPKLAASPEKIVSSQGSFLGSSPSGTMTDRQMLPPVEGVHLLSSGGQQSFFDSRTLGSLTLSSSQVSAHMV

SEQ ID NO: 87256 - protein, 176 aa, Homo sapiens
  Payload ID: 17458
  Gene Symbol: TBX18
  Gene Name: T-box 18
  ENSP ID: ENSP00000475498
MIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGFRDSGRN

SEQ ID NO: 87257 - protein, 232 aa, Homo sapiens
  Payload ID: 17458
  Gene Symbol: TBX18
  Gene Name: T-box 18
  ENSP ID: ENSP00000475873
MIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGFRDSGRNRMGLEALVESYAFWRPSLRTLTFEDIPGIPKQEYRDLKTDYIFPERDNLVSRETKL

SEQ ID NO: 87258 - protein, 32 aa, Homo sapiens
  Payload ID: 17458
  Gene Symbol: TBX18
  Gene Name: T-box 18
  ENSP ID: ENSP00000476137
MIITKAGRRMFPAMRVKISGLDPHQQYYIAMD

SEQ ID NO: 87259 - protein, 448 aa, Homo sapiens
  Payload ID: 17459
  Gene Symbol: TBX19
  Gene Name: T-box 19
  Uniprot ID: O60806
  ENSP ID: ENSP00000356795
MAMSELGTRKPSDGTVSHLLNVVESELQAGREKGDPTEKQLQIILEDAPLWQRFKEVTNEMIVTKNGRRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 87260 - protein, 281 aa, Homo sapiens
  Payload ID: 17459
  Gene Symbol: TBX19
  Gene Name: T-box 19
  ENSP ID: ENSP00000390731
  MOD_RES (1)..(1): Any amino acid
XKERELNWFYRRQRVLFAHVYPTFTNTSCLCKCKITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 87261 - protein, 318 aa, Homo sapiens
  Payload ID: 17459
  Gene Symbol: TBX19
  Gene Name: T-box 19
  ENSP ID: ENSP00000397540
  MOD_RES (1)..(1): Any amino acid
XRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 87262 - protein, 712 aa, Homo sapiens
  Payload ID: 17460
  Gene Symbol: TBX2
  Gene Name: T-box 2
  Uniprot ID: Q13207
  ENSP ID: ENSP00000240328
MREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 87263 - protein, 146 aa, Homo sapiens
  Payload ID: 17460
  Gene Symbol: TBX2
  Gene Name: T-box 2
  ENSP ID: ENSP00000404781
MREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRCESAAWTRRPSISC

SEQ ID NO: 87264 - protein, 447 aa, Homo sapiens
  Payload ID: 17461
  Gene Symbol: TBX20
  Gene Name: T-box 20
  Uniprot ID: Q9UMR3
  ENSP ID: ENSP00000386170
MEFTASPKPQLSSRANAFSIAALMSSGGSKEKEATENTIKPLEQFVEKSSCAQPLGELTSLDAHGEFGGGSGSSPSSSSLCTEPLIPTTPIIPSEEMAKIACSLETKELWDKFHELGTEMIITKSGRRMFPTIRVSFSGVDPEAKYIVLMDIVPVDNKRYRYAYHRSSWLVAGKADPPLPARLYVHPDSPFTGEQLLKQMVSFEKVKLTNNELDQHGHIILNSMHKYQPRVHIIKKKDHTASLLNLKSEEFRTFIFPETVFTAVTAYQNQLITKLKIDSNPFAKGFRDSSRLTDIERESVESLIQKHSYARSPIRTYGGEEDVLGDESQTTPNRGSAFTTSDNLSLSSWVSSSSSFPGFQHPQSLTALGTSTASIATPIPHPIQGSLPPYSRLGMPLTPSAIASSMQGSGPTFPSFHMPRYHHYFQQGPYAAIQGLRHSSAVMTPFV

SEQ ID NO: 87265 - protein, 535 aa, Homo sapiens
  Payload ID: 17462
  Gene Symbol: TBX21
  Gene Name: T-box 21
  Uniprot ID: Q9UL17
  ENSP ID: ENSP00000177694
MGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 87266 - protein, 520 aa, Homo sapiens
  Payload ID: 17463
  Gene Symbol: TBX22
  Gene Name: T-box 22
  Uniprot ID: Q9Y458
  ENSP ID: ENSP00000362390
MALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGRRMFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 87267 - protein, 520 aa, Homo sapiens; identical to SEQ ID NO: 87266
  Payload ID: 17463
  Gene Symbol: TBX22
  Gene Name: T-box 22
  Uniprot ID: Q9Y458
  ENSP ID: ENSP00000362393

SEQ ID NO: 87268 - protein, 520 aa, Homo sapiens; identical to SEQ ID NO: 87266
  Payload ID: 17463
  Gene Symbol: TBX22
  Gene Name: T-box 22
  Uniprot ID: Q9Y458
  ENSP ID: ENSP00000479825

SEQ ID NO: 87269 - protein, 127 aa, Homo sapiens
  Payload ID: 17463
  Gene Symbol: TBX22
  Gene Name: T-box 22
  ENSP ID: ENSP00000485704
MALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGGCSPLFGSR

SEQ ID NO: 87270 - protein, 71 aa, Homo sapiens
  Payload ID: 17463
  Gene Symbol: TBX22
  Gene Name: T-box 22
  ENSP ID: ENSP00000485926
  MOD_RES (1)..(1): Any amino acid
XKTEPSTSASSGCGSDSGYGNSSESLEEKDIQMELQGSELWKRFHDIGTEMIITKAGRFGSAQAVHKGHTH

SEQ ID NO: 87271 - protein, 520 aa, Homo sapiens; identical to SEQ ID NO: 87266
  Payload ID: 17463
  Gene Symbol: TBX22
  Gene Name: T-box 22
  Uniprot ID: Q9Y458
  ENSP ID: ENSP00000487295

SEQ ID NO: 87272 - protein, 127 aa, Homo sapiens; identical to SEQ ID NO: 87269
  Payload ID: 17463
  Gene Symbol: TBX22
  Gene Name: T-box 22
  ENSP ID: ENSP00000487527

SEQ ID NO: 87273 - protein, 743 aa, Homo sapiens
  Payload ID: 17464
  Gene Symbol: TBX3
  Gene Name: T-box 3
  Uniprot ID: O15119
  ENSP ID: ENSP00000257566
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 87274 - protein, 723 aa, Homo sapiens
  Payload ID: 17464
  Gene Symbol: TBX3
  Gene Name: T-box 3
  Uniprot ID: O15119
  ENSP ID: ENSP00000257567
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 87275 - protein, 722 aa, Homo sapiens
  Payload ID: 17464
  Gene Symbol: TBX3
  Gene Name: T-box 3
  ENSP ID: ENSP00000480048
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASLRQPPARCTAPLLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 87276 - protein, 545 aa, Homo sapiens
  Payload ID: 17465
  Gene Symbol: TBX4
  Gene Name: T-box 4
  Uniprot ID: P57082
  ENSP ID: ENSP00000240335
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRDGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 87277 - protein, 546 aa, Homo sapiens
  Payload ID: 17465
  Gene Symbol: TBX4
  Gene Name: T-box 4
  Uniprot ID: P57082
  ENSP ID: ENSP00000377435
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRADGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 87278 - protein, 135 aa, Homo sapiens
  Payload ID: 17465
  Gene Symbol: TBX4
  Gene Name: T-box 4
  ENSP ID: ENSP00000467588
MIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPE

SEQ ID NO: 87279 - protein, 518 aa, Homo sapiens
  Payload ID: 17466
  Gene Symbol: TBX5
  Gene Name: T-box 5
  Uniprot ID: Q99593
  ENSP ID: ENSP00000309913
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 87280 - protein, 468 aa, Homo sapiens
  Payload ID: 17466
  Gene Symbol: TBX5
  Gene Name: T-box 5
  Uniprot ID: Q99593
  ENSP ID: ENSP00000337723
MEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 87281 - protein, 518 aa, Homo sapiens; identical to SEQ ID NO: 87279
  Payload ID: 17466
  Gene Symbol: TBX5
  Gene Name: T-box 5
  Uniprot ID: Q99593
  ENSP ID: ENSP00000384152

SEQ ID NO: 87282 - protein, 349 aa, Homo sapiens
  Payload ID: 17466
  Gene Symbol: TBX5
  Gene Name: T-box 5
  Uniprot ID: Q99593
  ENSP ID: ENSP00000433292
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKGECDHPWSICFLSYLFLSLGWG

SEQ ID NO: 87283 - protein, 436 aa, Homo sapiens
  Payload ID: 17467
  Gene Symbol: TBX6
  Gene Name: T-box 6
  Uniprot ID: O95947
  ENSP ID: ENSP00000279386
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRERDARVKRKLRGPEPAATEAYGSGDTPGGPCDSTLGGDIRESDPEQAPAPGEATAAPAPLCGGPSAEAYLLHPAAFHGAPSHLPTRSPSFPEAPDSGRSAPYSAAFLELPHGSGGSGYPAAPPAVPFAPHFLQGGPFPLPYTAPGGYLDVGSKPMY

SEQ ID NO: 87284 - protein, 436 aa, Homo sapiens; identical to SEQ ID NO: 87283
  Payload ID: 17467
  Gene Symbol: TBX6
  Gene Name: T-box 6
  Uniprot ID: O95947
  ENSP ID: ENSP00000378650

SEQ ID NO: 87285 - protein, 295 aa, Homo sapiens
  Payload ID: 17467
  Gene Symbol: TBX6
  Gene Name: T-box 6
  Uniprot ID: O95947
  ENSP ID: ENSP00000460425
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRWELFIHLFMHSTNVY

SEQ ID NO: 87286 - protein, 295 aa, Homo sapiens; identical to SEQ ID NO: 87285
  Payload ID: 17467
  Gene Symbol: TBX6
  Gene Name: T-box 6
  Uniprot ID: O95947
  ENSP ID: ENSP00000461223

SEQ ID NO: 87287 - protein, 436 aa, Homo sapiens
  Payload ID: 17467
  Gene Symbol: TBX6
  Gene Name: T-box 6
  ENSP ID: ENSP00000485762
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQVSDPAGGGGPLPRPSSSSPPLFPRERDARVKRKLRGPEPAATEAYGSGDTPGGPCDSTLGGDIRESDPEQAPAPGEATAAPAPLCGGPSAEAYLLHPAAFHGAPSHLPTRSPSFPEAPDSGRSAPYSAAFLELPHGSGGSGYPAAPPAVPFAPHFLQGGPFPLPYTAPGGYLDVGSKPMY

SEQ ID NO: 87288 - protein, 682 aa, Homo sapiens
  Payload ID: 17468
  Gene Symbol: TBR1
  Gene Name: T-box, brain, 1
  Uniprot ID: Q16650
  ENSP ID: ENSP00000374205
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNIFVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 87289 - protein, 395 aa, Homo sapiens
  Payload ID: 17468
  Gene Symbol: TBR1
  Gene Name: T-box, brain, 1
  Uniprot ID: Q16650
  ENSP ID: ENSP00000387023
MHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 87290 - protein, 232 aa, Homo sapiens
  Payload ID: 17468
  Gene Symbol: TBR1
  Gene Name: T-box, brain, 1
  ENSP ID: ENSP00000393934
FQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFQAEDPGAPSPQRWFVTPANNRLDFAASAYDTATDFAGNAATLLSYAAAGVKALPLQAAGCT

SEQ ID NO: 87291 - protein, 186 aa, Homo sapiens
  Payload ID: 17469
  Gene Symbol: TBPL1
  Gene Name: TBP-like 1
  Uniprot ID: P62380
  ENSP ID: ENSP00000237264
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTGPNVKAVATAVEQIYPFVFESRKEIL

SEQ ID NO: 87292 - protein, 91 aa, Homo sapiens
  Payload ID: 17469
  Gene Symbol: TBPL1
  Gene Name: TBP-like 1
  ENSP ID: ENSP00000356843
MDADSDVALDILITNVVCVFRTRCHLNLRKIALEGANVIYKRDVGKVLMKLRKPRITATIWSSGKIICTGATSEEEAKFGARRLARSLQKL

SEQ ID NO: 87293 - protein, 163 aa, Homo sapiens
  Payload ID: 17469
  Gene Symbol: TBPL1
  Gene Name: TBP-like 1
  ENSP ID: ENSP00000356845
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTGIL

SEQ ID NO: 87294 - protein, 45 aa, Homo sapiens
  Payload ID: 17469
  Gene Symbol: TBPL1
  Gene Name: TBP-like 1
  ENSP ID: ENSP00000398186
MDADSDVALDILITNVVCVFRTRCHLNLRKIALEGANVIYKRDVG

SEQ ID NO: 87295 - protein, 128 aa, Homo sapiens
  Payload ID: 17469
  Gene Symbol: TBPL1
  Gene Name: TBP-like 1
  ENSP ID: ENSP00000402864
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHA

SEQ ID NO: 87296 - protein, 186 aa, Homo sapiens; identical to SEQ ID NO: 87291
  Payload ID: 17469
  Gene Symbol: TBPL1
  Gene Name: TBP-like 1
  Uniprot ID: P62380
  ENSP ID: ENSP00000478795

SEQ ID NO: 87297 - protein, 657 aa, Homo sapiens
  Payload ID: 17470
  Gene Symbol: TIPARP
  Gene Name: TCDD-inducible poly(ADP-ribose) polymerase
  Uniprot ID: Q7Z3E1
  ENSP ID: ENSP00000295924
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 87298 - protein, 657 aa, Homo sapiens; identical to SEQ ID NO: 87297
  Payload ID: 17470
  Gene Symbol: TIPARP
  Gene Name: TCDD-inducible poly(ADP-ribose) polymerase
  Uniprot ID: Q7Z3E1
  ENSP ID: ENSP00000418757

SEQ ID NO: 87299 - protein, 654 aa, Homo sapiens
  Payload ID: 17470
  Gene Symbol: TIPARP
  Gene Name: TCDD-inducible poly(ADP-ribose) polymerase
  ENSP ID: ENSP00000418829
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNT

SEQ ID NO: 87300 - protein, 506 aa, Homo sapiens
  Payload ID: 17470
  Gene Symbol: TIPARP
  Gene Name: TCDD-inducible poly(ADP-ribose) polymerase
  ENSP ID: ENSP00000419982
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEK

SEQ ID NO: 87301 - protein, 360 aa, Homo sapiens
  Payload ID: 17470
  Gene Symbol: TIPARP
  Gene Name: TCDD-inducible poly(ADP-ribose) polymerase
  ENSP ID: ENSP00000420141
  MOD_RES (1)..(1): Any amino acid
XTNKLEQPRGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 87302 - protein, 657 aa, Homo sapiens; identical to SEQ ID NO: 87297
  Payload ID: 17470
  Gene Symbol: TIPARP
  Gene Name: TCDD-inducible poly(ADP-ribose) polymerase
  Uniprot ID: Q7Z3E1
  ENSP ID: ENSP00000420612

SEQ ID NO: 87303 - protein, 657 aa, Homo sapiens; identical to SEQ ID NO: 87297
  Payload ID: 17470
  Gene Symbol: TIPARP
  Gene Name: TCDD-inducible poly(ADP-ribose) polymerase
  Uniprot ID: Q7Z3E1
  ENSP ID: ENSP00000438345

SEQ ID NO: 87304 - protein, 553 aa, Homo sapiens
  Payload ID: 17471
  Gene Symbol: TAGAP
  Gene Name: T-cell activation RhoGTPase activating protein
  Uniprot ID: Q8N103
  ENSP ID: ENSP00000322650
MGALEMQDEEDRIEALKQVADKLPRPNLLLLKHLVYVLHLISKNSEVNRMDSSNLAICIGPNMLTLENDQSLSFEAQKDLNNKVKTLVEFLIDNCFEIFGENIPVHSSITSDDSLEHTDSSDVSTLQNDSAYDSNDPDVESNSSSGISSPSRQPQVPMATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARLVASESQTVGSMTVGSMRARMLEAHCLLPPLPPAHHVEDSRHRGSKEPLPGHGLSPLPERWKQSRTVHASGDSLGHVSGPGRPELLPLRTVSESVQRNKRDCLVRRCSQPVFEADQFQYAKESYI

SEQ ID NO: 87305 - protein, 266 aa, Homo sapiens
  Payload ID: 17471
  Gene Symbol: TAGAP
  Gene Name: T-cell activation RhoGTPase activating protein
  Uniprot ID: Q8N103
  ENSP ID: ENSP00000340217
MKLRSSHNASKTLNANNMETLIECQSEGDIKEHPLLASCESEDSICQLIEVKKRKKVLSWPFLMRRLSPASDFSGALETDLKASLFDQPLSIICGDSDTLPRPIQDILTILCLKGPSTEGIFRRAANEKARKELKEELNSGDAVDLERLPVHLLAVVFKDFLRSIPRKLLSSDLFEEWMGALEMQDEEDRIEALKQVADKLPRPNLLLLKHLVYVLHLISKNSEVNRMDSSNLAICIGPNMLTLENDQSLSFEAQKDLNNKVCSAY

SEQ ID NO: 87306 - protein, 731 aa, Homo sapiens
  Payload ID: 17471
  Gene Symbol: TAGAP
  Gene Name: T-cell activation RhoGTPase activating protein
  Uniprot ID: Q8N103
  ENSP ID: ENSP00000356033
MKLRSSHNASKTLNANNMETLIECQSEGDIKEHPLLASCESEDSICQLIEVKKRKKVLSWPFLMRRLSPASDFSGALETDLKASLFDQPLSIICGDSDTLPRPIQDILTILCLKGPSTEGIFRRAANEKARKELKEELNSGDAVDLERLPVHLLAVVFKDFLRSIPRKLLSSDLFEEWMGALEMQDEEDRIEALKQVADKLPRPNLLLLKHLVYVLHLISKNSEVNRMDSSNLAICIGPNMLTLENDQSLSFEAQKDLNNKVKTLVEFLIDNCFEIFGENIPVHSSITSDDSLEHTDSSDVSTLQNDSAYDSNDPDVESNSSSGISSPSRQPQVPMATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARLVASESQTVGSMTVGSMRARMLEAHCLLPPLPPAHHVEDSRHRGSKEPLPGHGLSPLPERWKQSRTVHASGDSLGHVSGPGRPELLPLRTVSESVQRNKRDCLVRRCSQPVFEADQFQYAKESYI

SEQ ID NO: 87307 - protein, 331 aa, Homo sapiens
  Payload ID: 17472
  Gene Symbol: TAL1
  Gene Name: T-cell acute lymphocytic leukemia 1
  Uniprot ID: P17542
  ENSP ID: ENSP00000294339
MTERPPSEAARSDPQLEGRDAAEASMAPPHLVLLNGVAKETSRAAAAEPPVIELGARGGPGGGPAGGGGAARDLKGRDAATAEARHRVPTTELCRPPGPAPAPAPASVTAELPGDGRMVQLSPPALAAPAAPGRALLYSLSQPLASLGSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 87308 - protein, 331 aa, Homo sapiens; identical to SEQ ID NO: 87307
  Payload ID: 17472
  Gene Symbol: TAL1
  Gene Name: T-cell acute lymphocytic leukemia 1
  Uniprot ID: P17542
  ENSP ID: ENSP00000360951

SEQ ID NO: 87309 - protein, 108 aa, Homo sapiens
  Payload ID: 17473
  Gene Symbol: TAL2
  Gene Name: T-cell acute lymphocytic leukemia 2
  Uniprot ID: Q16559
  ENSP ID: ENSP00000334547
MTRKIFTNTRERWRQQNVNSAFAKLRKLIPTHPPDKKLSKNETLRLAMRYINFLVKVLGEQSLQQTGVAAQGNILGLFPQGPHLPGLEDRTLLENYQVPSPGPSHHIP

SEQ ID NO: 87310 - protein, 378 aa, Homo sapiens
  Payload ID: 17474
  Gene Symbol: TIMD4
  Gene Name: T-cell immunoglobulin and mucin domain containing 4
  Uniprot ID: Q96H15
  ENSP ID: ENSP00000274532
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 87311 - protein, 80 aa, Homo sapiens
  Payload ID: 17474
  Gene Symbol: TIMD4
  Gene Name: T-cell immunoglobulin and mucin domain containing 4
  ENSP ID: ENSP00000385882
MDGIPMSMKNEMPISQLLMIIAPSLGFVLFALFVAFLLRGKLMETYCSQKHTRLDYIGDSKNVLNDVQHGREDEDGLFTL

SEQ ID NO: 87312 - protein, 350 aa, Homo sapiens
  Payload ID: 17474
  Gene Symbol: TIMD4
  Gene Name: T-cell immunoglobulin and mucin domain containing 4
  Uniprot ID: Q96H15
  ENSP ID: ENSP00000385973
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 87313 - protein, 330 aa, Homo sapiens
  Payload ID: 17475
  Gene Symbol: TLX1
  Gene Name: T-cell leukemia homeobox 1
  Uniprot ID: P31314
  ENSP ID: ENSP00000359215
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKKPRTSFTRLQICELEKRFHRQKYLASAERAALAKALKMTDAQVKTWFQNRRTKWRRQTAEEREAERQQANRILLQLQQEAFQKSLAQPLPADPLCVHNSSLFALQNLQPWSDDSTKITSVTSVASACE

SEQ ID NO: 87314 - protein, 156 aa, Homo sapiens
  Payload ID: 17475
  Gene Symbol: TLX1
  Gene Name: T-cell leukemia homeobox 1
  ENSP ID: ENSP00000434358
AAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTVALSPFTVTRRIGHPYQNRTPPKKKKPRT

SEQ ID NO: 87315 - protein, 257 aa, Homo sapiens
  Payload ID: 17475
  Gene Symbol: TLX1
  Gene Name: T-cell leukemia homeobox 1
  Uniprot ID: P31314
  ENSP ID: ENSP00000434914
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKKPRTSFTRLQICELEKRFHRQKYLASAERAALAKALKMTDAQVKTWFQNRRTKWR

SEQ ID NO: 87316 - protein, 284 aa, Homo sapiens
  Payload ID: 17476
  Gene Symbol: TLX2
  Gene Name: T-cell leukemia homeobox 2
  Uniprot ID: O43763
  ENSP ID: ENSP00000233638
MEPGMLGPHNLPHHEPISFGIDQILSGPETPGGGLGLGRGGQGHGENGAFSGGYHGASGYGPAGSLAPLPGSSGVGPGGVIRVPAHRPLPVPPPAGGAPAVPGPSGLGGAGGLAGLTFPWMDSGRRFAKDRLTAALSPFSGTRRIGHPYQNRTPPKRKKPRTSFSRSQVLELERRFLRQKYLASAERAALAKALRMTDAQVKTWFQNRRTKWRRQTAEEREAERHRAGRLLLHLQQDALPRPLRPPLPPDPLCLHNSSLFALQNLQPWAEDNKVASVSGLASVV

SEQ ID NO: 87317 - protein, 235 aa, Homo sapiens
  Payload ID: 17476
  Gene Symbol: TLX2
  Gene Name: T-cell leukemia homeobox 2
  ENSP ID: ENSP00000482690
MEARCALALLWDAPHRPPLPKPDPSEAEEAAHVLLPLTGAGVGAALPAPEVPGLCGEGGAGQGLAHDRRTGQNVVPEPTHQVAAPDGGGARGRAAPRGPAAPASAAGRVATAAAAAAAPGPSLPAQLVALRAAEPAALGRGQQSGFSVRARLGGVSDARPIGVERRARSGGARGCLRPWSSGSRAREERQALRLSSRAPPPPAGSQASVAQMHGQLRGGLSRHFSLHCRYALAGT

SEQ ID NO: 87318 - protein, 291 aa, Homo sapiens
  Payload ID: 17477
  Gene Symbol: TLX3
  Gene Name: T-cell leukemia homeobox 3
  Uniprot ID: O43711
  ENSP ID: ENSP00000296921
MEAPASAQTPHPHEPISFGIDQILNSPDQDSAPAPRGPDGASYLGGPPGGRPGATYPSLPASFAGLGAPFEDAGSYSVNLSLAPAGVIRVPAHRPLPGAVPPPLPSALPAMPSVPTVSSLGGLNFPWMESSRRFVKDRFTAAAALTPFTVTRRIGHPYQNRTPPKRKKPRTSFSRVQICELEKRFHRQKYLASAERAALAKSLKMTDAQVKTWFQNRRTKWRRQTAEEREAERQQASRLMLQLQHDAFQKSLNDSIQPDPLCLHNSSLFALQNLQPWEEDSSKVPAVTSLV

SEQ ID NO: 87319 - protein, 103 aa, Homo sapiens
  Payload ID: 17478
  Gene Symbol: TCTA
  Gene Name: T-cell leukemia translocation altered
  Uniprot ID: P57738
  ENSP ID: ENSP00000273590
MAESWSGQALQALPATVLGALGSEFLREWEAQDMRVTLFKLLLLWLVLSLLGIQLAWGFYGNTVTGLYHRPGLGGQNGSTPDGSTHFPSWEMAANEPLKTHRE

SEQ ID NO: 87320 - protein, 114 aa, Homo sapiens
  Payload ID: 17479
  Gene Symbol: TCL1A
  Gene Name: T-cell leukemia/lymphoma 1A
  Uniprot ID: P56279
  ENSP ID: ENSP00000385036
MAECPTLGEAVTDHPDRLWAWEKFVYLDEKQHAWLPLTIEIKDRLQLRVLLRREDVVLGRPMTPTQIGPSLLPIMWQLYPDGRYRSSDSSFWRLVYHIKIDGVEDMLLELLPDD

SEQ ID NO: 87321 - protein, 114 aa, Homo sapiens; identical to SEQ ID NO: 87320
  Payload ID: 17479
  Gene Symbol: TCL1A
  Gene Name: T-cell leukemia/lymphoma 1A
  Uniprot ID: P56279
  ENSP ID: ENSP00000450496

SEQ ID NO: 87322 - protein, 114 aa, Homo sapiens; identical to SEQ ID NO: 87320
  Payload ID: 17479
  Gene Symbol: TCL1A
  Gene Name: T-cell leukemia/lymphoma 1A
  Uniprot ID: P56279
  ENSP ID: ENSP00000450701

SEQ ID NO: 87323 - protein, 46 aa, Homo sapiens
  Payload ID: 17479
  Gene Symbol: TCL1A
  Gene Name: T-cell leukemia/lymphoma 1A
  ENSP ID: ENSP00000450997
MAECPTLGEAVTDHPDRLWAWEKFVYLDEKQHAWLPLTIEIQGLAL

SEQ ID NO: 87324 - protein, 46 aa, Homo sapiens; identical to SEQ ID NO: 87323
  Payload ID: 17479
  Gene Symbol: TCL1A
  Gene Name: T-cell leukemia/lymphoma 1A
  ENSP ID: ENSP00000451322

SEQ ID NO: 87325 - protein, 114 aa, Homo sapiens; identical to SEQ ID NO: 87320
  Payload ID: 17479
  Gene Symbol: TCL1A
  Gene Name: T-cell leukemia/lymphoma 1A
  Uniprot ID: P56279
  ENSP ID: ENSP00000451506

SEQ ID NO: 87326 - protein, 46 aa, Homo sapiens; identical to SEQ ID NO: 87323
  Payload ID: 17479
  Gene Symbol: TCL1A
  Gene Name: T-cell leukemia/lymphoma 1A
  ENSP ID: ENSP00000451973

SEQ ID NO: 87327 - protein, 53 aa, Homo sapiens
  Payload ID: 17479
  Gene Symbol: TCL1A
  Gene Name: T-cell leukemia/lymphoma 1A
  ENSP ID: ENSP00000452028
MTPTQIGPSLLPIMWQLYPDGRYRSSDSSFWRLVYHIKIDGVEDMLLELLPDD

SEQ ID NO: 87328 - protein, 128 aa, Homo sapiens
  Payload ID: 17480
  Gene Symbol: TCL1B
  Gene Name: T-cell leukemia/lymphoma 1B
  Uniprot ID: O95988
  ENSP ID: ENSP00000343223
MASEASVRLGVPPGRLWIQRPGIYEDEEGRTWVTVVVRFNPSRREWARASQGSRYEPSITVHLWQMAVHTRELLSSGQMPFSQLPAVWQLYPGRKYRAADSSFWEIADHGQIDSMEQLVLTYQPERKD

SEQ ID NO: 87329 - protein, 1591 aa, Homo sapiens
  Payload ID: 17481
  Gene Symbol: TIAM1
  Gene Name: T-cell lymphoma invasion and metastasis 1
  Uniprot ID: Q13009
  ENSP ID: ENSP00000286827
MGNAESQHVEHEFYGEKHASLGRKHTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANGGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTQSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQSPSPQDSTGPQLATMRQLSDADKLRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRAVSAPSKSLGRRRRRLARNRFTIDSDAVSASSPEKESQQPPGGGDTDRWVEEQFDLAQYEEQDDIKETDILSDDDEFCESVKGASVDRDLQERLQATSISQRERGRKTLDSHASRMAQLKKQAALSGINGGLESASEEVIWVRREDFAPSRKLNTEI

SEQ ID NO: 87330 - protein, 225 aa, Homo sapiens
  Payload ID: 17481
  Gene Symbol: TIAM1
  Gene Name: T-cell lymphoma invasion and metastasis 1
  ENSP ID: ENSP00000388217
MGNAESQHVEHEFYGEKHASLGRKHTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLST

SEQ ID NO: 87331 - protein, 132 aa, Homo sapiens
  Payload ID: 17481
  Gene Symbol: TIAM1
  Gene Name: T-cell lymphoma invasion and metastasis 1
  ENSP ID: ENSP00000393384
  MOD_RES (1)..(1): Any amino acid
XSADAEANAVCEIVHVKSESEGRPERVFHLCCSSPESRKDFLKAVHSILRDKHRRQLLKTESLPSSQQYVPFGGKRLCALKGARPAMSRADGKRKQRLLIVAFTGSSATHPSENTRKSGAWRGCHCLLYIRS

SEQ ID NO: 87332 - protein, 1531 aa, Homo sapiens
  Payload ID: 17481
  Gene Symbol: TIAM1
  Gene Name: T-cell lymphoma invasion and metastasis 1
  Uniprot ID: Q13009
  ENSP ID: ENSP00000441570
MGNAESQHVEHEFYGEKHASLGRKHTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANGGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQREKEVVLPNVHQHNPDCDIWVHEYFTPSWFCLPNNQPALTVVRPGDTARDTLELICKLYKEIEICPKVTQSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQSPSPQDSTGPQLATMRQLSDADKLRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRAVSAPSKSLGRRRRRLARNRFTIDSDAVSASSPEKESQQPPGGGDTDRWVEEQFDLAQYEEQDDIKETDILSDDDEFCESVKGASVDRDLQERLQATSISQRERGRKTLDSHASRMAQLKKQAALSGINGGLESASEEVIWVRREDFAPSRKLNTEI

SEQ ID NO: 87333 - protein, 626 aa, Homo sapiens
  Payload ID: 17482
  Gene Symbol: TIAM2
  Gene Name: T-cell lymphoma invasion and metastasis 2
  Uniprot ID: Q8IVF5
  ENSP ID: ENSP00000275246
MEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 87334 - protein, 1701 aa, Homo sapiens
  Payload ID: 17482
  Gene Symbol: TIAM2
  Gene Name: T-cell lymphoma invasion and metastasis 2
  Uniprot ID: Q8IVF5
  ENSP ID: ENSP00000327315
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 87335 - protein, 1725 aa, Homo sapiens
  Payload ID: 17482
  Gene Symbol: TIAM2
  Gene Name: T-cell lymphoma invasion and metastasis 2
  Uniprot ID: Q8IVF5
  ENSP ID: ENSP00000353528
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQIFDSSGSHGFSGTQLPQNSSNSSEVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 87336 - protein, 1013 aa, Homo sapiens
  Payload ID: 17482
  Gene Symbol: TIAM2
  Gene Name: T-cell lymphoma invasion and metastasis 2
  Uniprot ID: Q8IVF5
  ENSP ID: ENSP00000407183
MDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 87337 - protein, 156 aa, Homo sapiens
  Payload ID: 17482
  Gene Symbol: TIAM2
  Gene Name: T-cell lymphoma invasion and metastasis 2
  ENSP ID: ENSP00000431269
MYSMSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERA

SEQ ID NO: 87338 - protein, 1730 aa, Homo sapiens
  Payload ID: 17482
  Gene Symbol: TIAM2
  Gene Name: T-cell lymphoma invasion and metastasis 2
  Uniprot ID: Q8IVF5
  ENSP ID: ENSP00000433348
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEQPEWSSEVMDVLDPRGKLTKGTLEEPRTLVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 87339 - protein, 1367 aa, Homo sapiens
  Payload ID: 17482
  Gene Symbol: TIAM2
  Gene Name: T-cell lymphoma invasion and metastasis 2
  ENSP ID: ENSP00000434901
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENC

SEQ ID NO: 87340 - protein, 1045 aa, Homo sapiens
  Payload ID: 17482
  Gene Symbol: TIAM2
  Gene Name: T-cell lymphoma invasion and metastasis 2
  ENSP ID: ENSP00000435335
MDLFRMRCYLASLQGGELPNPKSLLAAASRPSKLALGRLGILSVSSFHALVCSRDDSALRKRTLSLTQRGRNKKGIFSSLKGLDTLARKGKEKRPSITQIFDSSGSHGFSGTQLPQNSSNSSEVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLAKCVFLTVASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 87341 - protein, 1701 aa, Homo sapiens; identical to SEQ ID NO: 87334
  Payload ID: 17482
  Gene Symbol: TIAM2
  Gene Name: T-cell lymphoma invasion and metastasis 2
  Uniprot ID: Q8IVF5
  ENSP ID: ENSP00000437188

SEQ ID NO: 87342 - protein, 85 aa, Homo sapiens
  Payload ID: 17482
  Gene Symbol: TIAM2
  Gene Name: T-cell lymphoma invasion and metastasis 2
  ENSP ID: ENSP00000437435
MGNSDSQYTLQGSKNHSNTITGAKQIPCSLKIRGIHAKEEKSLHGWGHGSNGAGYKSRSLARSCLSHFKSNQPYASRLGGPTCKV

SEQ ID NO: 87343 - protein, 195 aa, Homo sapiens
  Payload ID: 17482
  Gene Symbol: TIAM2
  Gene Name: T-cell lymphoma invasion and metastasis 2
  ENSP ID: ENSP00000442989
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPV

SEQ ID NO: 87344 - protein, 53 aa, Homo sapiens
  Payload ID: 17482
  Gene Symbol: TIAM2
  Gene Name: T-cell lymphoma invasion and metastasis 2
  ENSP ID: ENSP00000443546
MGNSDSQYTLQGSKNHSNTITGAKQIPCSLKIRGIHAKEEKSLHGWGHGSNGA

SEQ ID NO: 87345 - protein, 53 aa, Homo sapiens; identical to SEQ ID NO: 87344
  Payload ID: 17482
  Gene Symbol: TIAM2
  Gene Name: T-cell lymphoma invasion and metastasis 2
  ENSP ID: ENSP00000444040

SEQ ID NO: 87346 - protein, 64 aa, Homo sapiens
  Payload ID: 17482
  Gene Symbol: TIAM2
  Gene Name: T-cell lymphoma invasion and metastasis 2
  ENSP ID: ENSP00000444897
  MOD_RES (1)..(1): Any amino acid
XFSEKSVGLTLIARPPDTKATLCTSWSDSDLFSRDQKSLLPPPNQSQLLEEFLDNFKKNTANEC

SEQ ID NO: 87347 - protein, 830 aa, Homo sapiens
  Payload ID: 17483
  Gene Symbol: TCIRG1
  Gene Name: T-cell, immune regulator 1, ATPase, H+ transporting, lysosomal V0 subunit A3
  Uniprot ID: Q13488
  ENSP ID: ENSP00000265686
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 87348 - protein, 174 aa, Homo sapiens
  Payload ID: 17483
  Gene Symbol: TCIRG1
  Gene Name: T-cell, immune regulator 1, ATPase, H+ transporting, lysosomal V0 subunit A3
  ENSP ID: ENSP00000431174
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVKASQPRG

SEQ ID NO: 87349 - protein, 290 aa, Homo sapiens
  Payload ID: 17483
  Gene Symbol: TCIRG1
  Gene Name: T-cell, immune regulator 1, ATPase, H+ transporting, lysosomal V0 subunit A3
  ENSP ID: ENSP00000431437
  MOD_RES (1)..(1): Any amino acid
XSFVAGAVEPHKAPALERLLWRACRGFLIASFRELEQPLEHPVTGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSLPGHRGCLRRGPLPGGQPRSLHHHHLPLPVCCDVRGCGPRAAHVPVRPGHGPCGEPTGCEGRAERDLADFLQGPLPAPAYGPVLHLHRLHLQRVLQSRHQHLPLGLECGRHGQPVW

SEQ ID NO: 87350 - protein, 299 aa, Homo sapiens
  Payload ID: 17483
  Gene Symbol: TCIRG1
  Gene Name: T-cell, immune regulator 1, ATPase, H+ transporting, lysosomal V0 subunit A3
  ENSP ID: ENSP00000432846
MGSMFRSEEVALVQLFLPTAAAYTCLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVST

SEQ ID NO: 87351 - protein, 61 aa, Homo sapiens
  Payload ID: 17483
  Gene Symbol: TCIRG1
  Gene Name: T-cell, immune regulator 1, ATPase, H+ transporting, lysosomal V0 subunit A3
  ENSP ID: ENSP00000432957
DDEEEAELVPSEVLMHQAIHTIEFCLGCVSNTASYLRLWALSLAHARWNSRTSSTQARATS

SEQ ID NO: 87352 - protein, 614 aa, Homo sapiens
  Payload ID: 17483
  Gene Symbol: TCIRG1
  Gene Name: T-cell, immune regulator 1, ATPase, H+ transporting, lysosomal V0 subunit A3
  Uniprot ID: Q13488
  ENSP ID: ENSP00000434407
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 87353 - protein, 217 aa, Homo sapiens
  Payload ID: 17483
  Gene Symbol: TCIRG1
  Gene Name: T-cell, immune regulator 1, ATPase, H+ transporting, lysosomal V0 subunit A3
  ENSP ID: ENSP00000435023
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWM

SEQ ID NO: 87354 - protein, 104 aa, Homo sapiens
  Payload ID: 17483
  Gene Symbol: TCIRG1
  Gene Name: T-cell, immune regulator 1, ATPase, H+ transporting, lysosomal V0 subunit A3
  ENSP ID: ENSP00000436082
  MOD_RES (1)..(1): Any amino acid
XALNQCSVSTTHKCLIAEAWCSVRDLPALQEALRDSSMEEGVSAVAHRIPCRDMPPTLIRTNRFTASFQGIVDAYGVGRYQEVNPDGEMEAQRGEVAGPRSHSS

SEQ ID NO: 87355 - protein, 193 aa, Homo sapiens
  Payload ID: 17484
  Gene Symbol: TFPT
  Gene Name: TCF3 (E2A) fusion partner (in childhood Leukemia)
  ENSP ID: ENSP00000375637
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEAMRRMSLQRKRHCPRPEGLLHPQNPAAQPPVRGPVGGRGGECHGMDAEQEMR

SEQ ID NO: 87356 - protein, 244 aa, Homo sapiens
  Payload ID: 17484
  Gene Symbol: TFPT
  Gene Name: TCF3 (E2A) fusion partner (in childhood Leukemia)
  ENSP ID: ENSP00000375638
MAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEDEGSQGTDAPTPGNAENEPPEKETLSPPRRTPAPPEPGSPAPGEGPSGRKRRRVPRDGRRAGNALTPELAPVQIKVEEDFGFEADEALDSSWVSRGPDKLLPYPTLASPASD

SEQ ID NO: 87357 - protein, 253 aa, Homo sapiens
  Payload ID: 17484
  Gene Symbol: TFPT
  Gene Name: TCF3 (E2A) fusion partner (in childhood Leukemia)
  Uniprot ID: P0C1Z6
  ENSP ID: ENSP00000375639
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEDEGSQGTDAPTPGNAENEPPEKETLSPPRRTPAPPEPGSPAPGEGPSGRKRRRVPRDGRRAGNALTPELAPVQIKVEEDFGFEADEALDSSWVSRGPDKLLPYPTLASPASD

SEQ ID NO: 87358 - protein, 105 aa, Homo sapiens
  Payload ID: 17484
  Gene Symbol: TFPT
  Gene Name: TCF3 (E2A) fusion partner (in childhood Leukemia)
  ENSP ID: ENSP00000395180
MELEQREGTMAAVGFEEFSAPPGSELALPPLFGGHILESELETEVEFVSGGLGGSGLRERDEEEEAARGRRRRQRELNRRKYQALGRRCREIEQVPHESAGLLRG

SEQ ID NO: 87359 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000477775

SEQ ID NO: 87360 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  Uniprot ID: P0C1Z6
  ENSP ID: ENSP00000480169

SEQ ID NO: 87361 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000480353

SEQ ID NO: 87362 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000481443

SEQ ID NO: 87363 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000482185

SEQ ID NO: 87364 - protein, 105 aa, Homo sapiens; identical to SEQ ID NO: 87358
  Payload ID: 17484
  Gene Symbol: TFPT
  Gene Name: TCF3 (E2A) fusion partner (in childhood Leukemia)
  ENSP ID: ENSP00000482618

SEQ ID NO: 87365 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000482785

SEQ ID NO: 87366 - protein, 145 aa, Homo sapiens
  Payload ID: 17484
  Gene Symbol: TFPT
  Gene Name: TCF3 (E2A) fusion partner (in childhood Leukemia)
  ENSP ID: ENSP00000482931
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEQEMR

SEQ ID NO: 87367 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000483417

SEQ ID NO: 87368 - protein, 193 aa, Homo sapiens; identical to SEQ ID NO: 87355
  Payload ID: 17484
  Gene Symbol: TFPT
  Gene Name: TCF3 (E2A) fusion partner (in childhood Leukemia)
  ENSP ID: ENSP00000483835

SEQ ID NO: 87369 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000483971

SEQ ID NO: 87370 - protein, 244 aa, Homo sapiens; identical to SEQ ID NO: 87356
  Payload ID: 17484
  Gene Symbol: TFPT
  Gene Name: TCF3 (E2A) fusion partner (in childhood Leukemia)
  ENSP ID: ENSP00000484338

SEQ ID NO: 87371 - protein, 253 aa, Homo sapiens; identical to SEQ ID NO: 87357
  Payload ID: 17484
  Gene Symbol: TFPT
  Gene Name: TCF3 (E2A) fusion partner (in childhood Leukemia)
  ENSP ID: ENSP00000484685

SEQ ID NO: 87372 - protein, 556 aa, Homo sapiens
  Payload ID: 17485
  Gene Symbol: TCP1
  Gene Name: t-complex 1
  Uniprot ID: P17987
  ENSP ID: ENSP00000317334
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 87373 - protein, 401 aa, Homo sapiens
  Payload ID: 17485
  Gene Symbol: TCP1
  Gene Name: t-complex 1
  ENSP ID: ENSP00000376008
MSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 87374 - protein, 433 aa, Homo sapiens
  Payload ID: 17485
  Gene Symbol: TCP1
  Gene Name: t-complex 1
  ENSP ID: ENSP00000390159
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMDWS

SEQ ID NO: 87375 - protein, 111 aa, Homo sapiens
  Payload ID: 17485
  Gene Symbol: TCP1
  Gene Name: t-complex 1
  ENSP ID: ENSP00000437840
MAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYIN

SEQ ID NO: 87376 - protein, 332 aa, Homo sapiens
  Payload ID: 17485
  Gene Symbol: TCP1
  Gene Name: t-complex 1
  ENSP ID: ENSP00000439447
MPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 87377 - protein, 136 aa, Homo sapiens
  Payload ID: 17485
  Gene Symbol: TCP1
  Gene Name: t-complex 1
  ENSP ID: ENSP00000439671
MAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSS

SEQ ID NO: 87378 - protein, 65 aa, Homo sapiens
  Payload ID: 17485
  Gene Symbol: TCP1
  Gene Name: t-complex 1
  ENSP ID: ENSP00000440617
MEGPLSVFGDRSTGETIRSQNVMAAASIANIVKSSLGPVGLDKMLVDDIGWFIFFPANFLGCNHY

SEQ ID NO: 87379 - protein, 221 aa, Homo sapiens
  Payload ID: 17485
  Gene Symbol: TCP1
  Gene Name: t-complex 1
  ENSP ID: ENSP00000441345
MEGPLSVFGDRSTGETIRSQNGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYL

SEQ ID NO: 87380 - protein, 59 aa, Homo sapiens
  Payload ID: 17485
  Gene Symbol: TCP1
  Gene Name: t-complex 1
  ENSP ID: ENSP00000442185
MELLQWEAVRYINENLIVNTDELGRDCLINAAKTSMSSKIIGINGDFFANMVVDAVLAI

SEQ ID NO: 87381 - protein, 91 aa, Homo sapiens
  Payload ID: 17485
  Gene Symbol: TCP1
  Gene Name: t-complex 1
  ENSP ID: ENSP00000442856
MAAASIANIVKSSLGPVGLDKMLVDDIGDVTITNDGATILKLLEVEHPAAKVLCELADLQDKEVGDGTTSVVIIAAELLKNADELVKQKIH

SEQ ID NO: 87382 - protein, 100 aa, Homo sapiens
  Payload ID: 17485
  Gene Symbol: TCP1
  Gene Name: t-complex 1
  ENSP ID: ENSP00000444423
MEGPLSVFGDRSTGETIRSQNVMAAASIANIVKSSLGPVGLDKMLVDDIGDVTITNDGATILKLLEVEHPAAKVLCELADLQDKEVGDGTTSVGSSALYQ

SEQ ID NO: 87383 - protein, 298 aa, Homo sapiens
  Payload ID: 17486
  Gene Symbol: TCP10
  Gene Name: t-complex 10
  Uniprot ID: Q12799
  ENSP ID: ENSP00000355792
MEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISHLSADEDTTPKYAGRKSQSATLLGQRWSSNHLAPPKPMSLKTERINSGKTPPQEDREKSPPGRRQDRSPAPTGRPTPGAERRGVSEDGKIMHPSSRSPQNSGGRKSPVQASQATTLQEQTAAARGADRSSSVLGSSEGGFLSRVQADEFASSAPDSAERQKNSTPMAPKKSCFPTGRWNISRMDRKRPYFLMGQS

SEQ ID NO: 87384 - protein, 326 aa, Homo sapiens
  Payload ID: 17486
  Gene Symbol: TCP10
  Gene Name: t-complex 10
  ENSP ID: ENSP00000380929
MEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISHLSADEDTTPKYAGRKSQSATLLGQRWSSNHLAPPKPMSLKTERINSGKTPPQEDREKSPPGRRQDRSPAPTGRPTPGAERRGVSEDGKIMHPSSRSPQNSGGRKSPVQASQATTLQEQTAAARGADRSSSVLGSSEGGFLSRVQADEFASSAPDSAERQNLPVNPPSSLEIAQAMDTKMKKEEVQEEKRHPKGKADDCRRSGFPSEFPGALHAAPSRQDMGP

SEQ ID NO: 87385 - protein, 95 aa, Homo sapiens
  Payload ID: 17486
  Gene Symbol: TCP10
  Gene Name: t-complex 10
  ENSP ID: ENSP00000423829
MEKTPAAAEVPREDSNAGEMPSLQQQITSLHQELGRQQSLWADIHRKLQSHMDALRKQNRELREELRGLQRQQWEAGKKPAASPHAGRESHTLVP

SEQ ID NO: 87386 - protein, 207 aa, Homo sapiens
  Payload ID: 17486
  Gene Symbol: TCP10
  Gene Name: t-complex 10
  ENSP ID: ENSP00000426065
GTRPRCSGPSRSDWRGPGEVMRSVSGAEGRGLPQTEGVTSLGPRTLGYPLGGAGKKKLSQGCEDRGPLPTSTETVPIPAGKEQPGIRLLALEPAFGKISHLSADEDTTPKYAGRKSQSATLLGQRWSSNHLAPPKPMSLKTERINSGKTPPQEDREKSPPGRRQDRSPAPTGRPTPGAERRGVSEDGKVTSETWVTLHWQHGKFRFR

SEQ ID NO: 87387 - protein, 107 aa, Homo sapiens
  Payload ID: 17486
  Gene Symbol: TCP10
  Gene Name: t-complex 10
  ENSP ID: ENSP00000427675
MEKTPAAAEVPREDSNAGEMPSLQQQITSLHQELGRQQSLWADIHRKLQSHMDALRKQNRELREELRGLQRQQWEAGKKPAASPHAGRESHTLVPKAHLCFCIICVV

SEQ ID NO: 87388 - protein, 352 aa, Homo sapiens
  Payload ID: 17486
  Gene Symbol: TCP10
  Gene Name: t-complex 10
  ENSP ID: ENSP00000484621
MLEGQLEAGPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISHLSADEDTTPKYAGRKSQSATLLGQRWSSNHLAPPKPMSLKTERINSGKTPPQEDREKSPPGRRQDRSPAPTGRPTPGAERRGVSEDGKIMHPSSRSPQNSGGRKSPVQASQATTLQEQTAAARGADRSSSVLGSSEGGFLSRVQADEFASSAPDSAERQNLPVNPPSSLEIAQAMDTKMKKEEVQEEKRHPKGKADDCRRSGFPSEFPGALHAAPSRQDMGP

SEQ ID NO: 87389 - protein, 215 aa, Homo sapiens
  Payload ID: 17487
  Gene Symbol: TCP10L
  Gene Name: t-complex 10-like
  Uniprot ID: Q8TDR4
  ENSP ID: ENSP00000300258
MLAGQLEARDPKEGTHPEDPCPGAGAVMEKTAVAAEVLTEDCNTGEMPPLQQQIIRLHQELGRQKSLWADVHGKLRSHIDALREQNMELREKLRALQLQRWKARKKSAASPHAGQESHTLALEPAFGKISPLSADEETIPKYAGHKNQSATLLGQRSSSNNSAPPKPMSLKIERISSWKTPPQENRDKNLSRRRQDRRATPTGRPTPCAERRGGV

SEQ ID NO: 87390 - protein, 191 aa, Homo sapiens
  Payload ID: 17487
  Gene Symbol: TCP10L
  Gene Name: t-complex 10-like
  ENSP ID: ENSP00000463050
MLAGQLEARDPKEGTHPEDPCPGAGAVMEKTAVAAEVLTEDCNTGEMPPLQQQIIRLHQELGRQKSLWADVHGKLRSHIDALREQNMELREKLRALQLQRWKARKKSAASPHAGQESHTLALEPAFGKISPLSADEETIPKYAGHKNQSATLLGQRSSSNNSAPPKPMSLKIERISSWKTPPQENRDKNLS

SEQ ID NO: 87391 - protein, 129 aa, Homo sapiens
  Payload ID: 17487
  Gene Symbol: TCP10L
  Gene Name: t-complex 10-like
  ENSP ID: ENSP00000476481
MELREKLRALQLQRWKARKKSAASPHAGQESHTLALEPAFGKISPLSADEETIPKYAGHKNQSATLLGQRSSSNNSAPPKPMSLKIERISSWKTPPQENRDKNLSRRRQDRRATPTGRPTPCAERRGGV

SEQ ID NO: 87392 - protein, 108 aa, Homo sapiens
  Payload ID: 17487
  Gene Symbol: TCP10L
  Gene Name: t-complex 10-like
  ENSP ID: ENSP00000476697
MELREKLRALQLQRWKARKKSAASPHAGQESHTLALEPAFGKISPLSADEETIPKYAGHKNQSATLLGQRSSSNNSAPPKLLFRTFSQPVCLFLSQLCVTLILRKQIS

SEQ ID NO: 87393 - protein, 307 aa, Homo sapiens
  Payload ID: 17488
  Gene Symbol: TCP10L2
  Gene Name: t-complex 10-like 2
  ENSP ID: ENSP00000283507
MLEGQLEAREPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKIMHPSSRSLQNSGGRKSPVQASQAATLQEQTAAAGVADRSSSVLGSSEGGFLSRVQAEEFASSSPDSAERQKNSTPMAPKKSCFPMGQ

SEQ ID NO: 87394 - protein, 353 aa, Homo sapiens
  Payload ID: 17488
  Gene Symbol: TCP10L2
  Gene Name: t-complex 10-like 2
  Uniprot ID: B9ZVM9
  ENSP ID: ENSP00000355797
MLEGQLEAREPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKIMHPSSRSLQNSGGRKSPVQASQAATLQEQTAAAGVADRSSSVLGSSEGGFLSRVQAEEFASSSPDSAERQNLPVNPPSSLEIAQAMDTKMKKEEVQEEKRHPNGKADDCRRSGFPSEFPGALHAAPSRQDMGP

SEQ ID NO: 87395 - protein, 44 aa, Homo sapiens
  Payload ID: 17488
  Gene Symbol: TCP10L2
  Gene Name: t-complex 10-like 2
  ENSP ID: ENSP00000440886
MLEGQLEAREPKEGTHPEDPCPGAGAAMEKTPAAAEVPREDSNA

SEQ ID NO: 87396 - protein, 407 aa, Homo sapiens
  Payload ID: 17489
  Gene Symbol: TCP11X2
  Gene Name: t-complex 11 family, X-linked 2
  Uniprot ID: Q5H9J9
  ENSP ID: ENSP00000392879
MYNAFWNHLKEQLLSTPPDFTCALELLKDVKENRLRNEIEEALDTDLLKQEAEHGALDVPHLSNYILNLMALLCAPVRDEAIQKLETIRDPVQLLRGILRVLGLMKMDMVNYTIQSFRPYLQEHSIQYEQAKFQELLDKQPSLLDYTTKWLTKAATDITTLCPSSPDSPSSSCSMACSLPSGAGNNSEPPSPTMVLYQGYLNLLLWDLENVEFPETLLMDRIRLQELAFQLHQLTVLASVLLVARSFSGEVLFRSPEFVDRLKCTTKALTEEFISRPEETMLSVSEQVSQEVHQGLKDMGLTTLSSENTASLLGQLQNITKKENCIRSIVDQWIRFFLKCCLLHGMQESLLHFPGGLILIEKELAELGWKFLNLMHHNQQVFGPYYAEILKHIIHPAQAQETDVEPN

SEQ ID NO: 87397 - protein, 122 aa, Homo sapiens
  Payload ID: 17489
  Gene Symbol: TCP11X2
  Gene Name: t-complex 11 family, X-linked 2
  ENSP ID: ENSP00000404462
MPKTEETVLQNDPSVAENGAPEPKTPGQSQKSKSFCLDDQSPDLIETVNEVSKLSISHEIVVNQDFYVEETILPPNSVEGRFAEAMYNAFWNHLKEQLLSTPPDFTCALELLKDVKENPGDE

SEQ ID NO: 87398 - protein, 441 aa, Homo sapiens
  Payload ID: 17490
  Gene Symbol: TCP11
  Gene Name: t-complex 11, testis-specific
  Uniprot ID: Q8WWU5
  ENSP ID: ENSP00000244645
MAPKGILGSFPTAMNLSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 87399 - protein, 516 aa, Homo sapiens
  Payload ID: 17490
  Gene Symbol: TCP11
  Gene Name: t-complex 11, testis-specific
  Uniprot ID: Q8WWU5
  ENSP ID: ENSP00000308708
MTRGGGGGDTISKMPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 87400 - protein, 470 aa, Homo sapiens
  Payload ID: 17490
  Gene Symbol: TCP11
  Gene Name: t-complex 11, testis-specific
  Uniprot ID: Q8WWU5
  ENSP ID: ENSP00000363085
MTRGGGGGVLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 87401 - protein, 441 aa, Homo sapiens; identical to SEQ ID NO: 87398
  Payload ID: 17490
  Gene Symbol: TCP11
  Gene Name: t-complex 11, testis-specific
  Uniprot ID: Q8WWU5
  ENSP ID: ENSP00000363091

SEQ ID NO: 87402 - protein, 54 aa, Homo sapiens
  Payload ID: 17490
  Gene Symbol: TCP11
  Gene Name: t-complex 11, testis-specific
  ENSP ID: ENSP00000399012
MTRGGGGGDTISKMPDVKESVPPKYPGDSEGRSCKPETSGPPQEDKSGSEDPPP

SEQ ID NO: 87403 - protein, 465 aa, Homo sapiens
  Payload ID: 17490
  Gene Symbol: TCP11
  Gene Name: t-complex 11, testis-specific
  Uniprot ID: Q8WWU5
  ENSP ID: ENSP00000402816
MTRGGGGGGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 87404 - protein, 511 aa, Homo sapiens
  Payload ID: 17490
  Gene Symbol: TCP11
  Gene Name: t-complex 11, testis-specific
  Uniprot ID: Q8WWU5
  ENSP ID: ENSP00000404479
MTRGGGGGDTISKMPDVKESVPPKYPGDSEGRSCKPETSGPPQEDKSGSEDPPPCLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 87405 - protein, 440 aa, Homo sapiens
  Payload ID: 17490
  Gene Symbol: TCP11
  Gene Name: t-complex 11, testis-specific
  Uniprot ID: Q8WWU5
  ENSP ID: ENSP00000415320
MNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 87406 - protein, 43 aa, Homo sapiens
  Payload ID: 17490
  Gene Symbol: TCP11
  Gene Name: t-complex 11, testis-specific
  ENSP ID: ENSP00000415562
MTRGGGGGVWKARSRRQCTMPFGTILKSNYQQLPLTSAVLLNF

SEQ ID NO: 87407 - protein, 221 aa, Homo sapiens
  Payload ID: 17490
  Gene Symbol: TCP11
  Gene Name: t-complex 11, testis-specific
  ENSP ID: ENSP00000421103
MDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRIT

SEQ ID NO: 87408 - protein, 69 aa, Homo sapiens
  Payload ID: 17490
  Gene Symbol: TCP11
  Gene Name: t-complex 11, testis-specific
  ENSP ID: ENSP00000421333
MNCDYYMEEKVLPPSSLEGKVKETVHNAFWDHLKEQLSATPPDFSCALELLKEIKEILLSLLLPRQNRL

SEQ ID NO: 87409 - protein, 41 aa, Homo sapiens
  Payload ID: 17490
  Gene Symbol: TCP11
  Gene Name: t-complex 11, testis-specific
  ENSP ID: ENSP00000421349
MPDVKESVPPKYPGDSEGRSCKPETSGPPQEDKSGSEDPPP

SEQ ID NO: 87410 - protein, 74 aa, Homo sapiens
  Payload ID: 17490
  Gene Symbol: TCP11
  Gene Name: t-complex 11, testis-specific
  ENSP ID: ENSP00000421386
MTRGGGGGDTISKMPDVKESVPPKYPGDSEGRSCKPETSGPPQEDKSGSEDPPPCPRAEVFKEFLVLEKEVTQA

SEQ ID NO: 87411 - protein, 54 aa, Homo sapiens; identical to SEQ ID NO: 87402
  Payload ID: 17490
  Gene Symbol: TCP11
  Gene Name: t-complex 11, testis-specific
  ENSP ID: ENSP00000421916

SEQ ID NO: 87412 - protein, 245 aa, Homo sapiens
  Payload ID: 17490
  Gene Symbol: TCP11
  Gene Name: t-complex 11, testis-specific
  ENSP ID: ENSP00000422105
  MOD_RES (1)..(1): Any amino acid
XGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIAQALETKVESV

SEQ ID NO: 87413 - protein, 89 aa, Homo sapiens
  Payload ID: 17490
  Gene Symbol: TCP11
  Gene Name: t-complex 11, testis-specific
  ENSP ID: ENSP00000422259
MTRGGGGGDTISKMPDVKESVPPKYPGDSEGRSCKPETSGPPQEDKSGSEDPPPFWKARSRRQCTMPFGTILKSNYQQLPLTSAVLLNF

SEQ ID NO: 87414 - protein, 103 aa, Homo sapiens
  Payload ID: 17490
  Gene Symbol: TCP11
  Gene Name: t-complex 11, testis-specific
  ENSP ID: ENSP00000422774
MAPKGILGSFPTAMNLSLEGKVKETVHNAFWDHLKEQLSATPPDFSCALELLKEIKEILLSLLLPRQNRLRIEIEEALDMDLLKQEAEHGALKVLYLSKYVLN

SEQ ID NO: 87415 - protein, 80 aa, Homo sapiens
  Payload ID: 17490
  Gene Symbol: TCP11
  Gene Name: t-complex 11, testis-specific
  ENSP ID: ENSP00000422940
MTRGGGGGDTISKMPDVKESVPPKYPGDSEGRSCKPETSGPPQEDKSGSEDPPPSSTMINSWPIFVHLHLLHILEPNNFL

SEQ ID NO: 87416 - protein, 84 aa, Homo sapiens
  Payload ID: 17490
  Gene Symbol: TCP11
  Gene Name: t-complex 11, testis-specific
  ENSP ID: ENSP00000423183
MNCDYYMEEKVLPPSSLEGKVKETVHNAFWDHLKEQLSATPPDFSCALELLKEIKEILLSLLLPRQNRLRIEIEEALDMDLLKQ

SEQ ID NO: 87417 - protein, 54 aa, Homo sapiens; identical to SEQ ID NO: 87402
  Payload ID: 17490
  Gene Symbol: TCP11
  Gene Name: t-complex 11, testis-specific
  ENSP ID: ENSP00000423293

SEQ ID NO: 87418 - protein, 43 aa, Homo sapiens; identical to SEQ ID NO: 87406
  Payload ID: 17490
  Gene Symbol: TCP11
  Gene Name: t-complex 11, testis-specific
  ENSP ID: ENSP00000424209

SEQ ID NO: 87419 - protein, 54 aa, Homo sapiens; identical to SEQ ID NO: 87402
  Payload ID: 17490
  Gene Symbol: TCP11
  Gene Name: t-complex 11, testis-specific
  ENSP ID: ENSP00000424332

SEQ ID NO: 87420 - protein, 35 aa, Homo sapiens
  Payload ID: 17490
  Gene Symbol: TCP11
  Gene Name: t-complex 11, testis-specific
  ENSP ID: ENSP00000425849
MTRGGGGGDTISKMPDVKESVPPKYPGDSEGRERN

SEQ ID NO: 87421 - protein, 503 aa, Homo sapiens
  Payload ID: 17490
  Gene Symbol: TCP11
  Gene Name: t-complex 11, testis-specific
  Uniprot ID: Q8WWU5
  ENSP ID: ENSP00000425995
MPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 87422 - protein, 440 aa, Homo sapiens; identical to SEQ ID NO: 87405
  Payload ID: 17490
  Gene Symbol: TCP11
  Gene Name: t-complex 11, testis-specific
  Uniprot ID: Q8WWU5
  ENSP ID: ENSP00000478603

SEQ ID NO: 87423 - protein, 509 aa, Homo sapiens
  Payload ID: 17491
  Gene Symbol: TCP11L1
  Gene Name: t-complex 11, testis-specific-like 1
  Uniprot ID: Q9NUJ3
  ENSP ID: ENSP00000335595
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKEIVHKAFWDCLSVQLSEDPPAYDHAIKLVGEIKETLLSFLLPGHTRLRNQITEVLDLDLIKQEAENGALDISKLAEFIIGMMGTLCAPARDEEVKKLKDIKEIVPLFREIFSVLDLMKVDMANFAISSIRPHLMQQSVEYERKKFQEILERQPNSLDFVTQWLEEASEDLMTQKYKHALPVGGMAAGSGDMPRLSPVAVQNYAYLKLLKWDHLQRPFPETVLMDQSRFHELQLQLEQLTILGAVLLVTFSMAAPGISSQADFAEKLKMIVKILLTDMHLPSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILSKILVRS

SEQ ID NO: 87424 - protein, 509 aa, Homo sapiens; identical to SEQ ID NO: 87423
  Payload ID: 17491
  Gene Symbol: TCP11L1
  Gene Name: t-complex 11, testis-specific-like 1
  Uniprot ID: Q9NUJ3
  ENSP ID: ENSP00000395070

SEQ ID NO: 87425 - protein, 154 aa, Homo sapiens
  Payload ID: 17491
  Gene Symbol: TCP11L1
  Gene Name: t-complex 11, testis-specific-like 1
  ENSP ID: ENSP00000431200
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENRVSLCCPGWSVVALSRLTATSGQADLELLTSGELPASASKSAGITGLEEESKGDCT

SEQ ID NO: 87426 - protein, 509 aa, Homo sapiens; identical to SEQ ID NO: 87423
  Payload ID: 17491
  Gene Symbol: TCP11L1
  Gene Name: t-complex 11, testis-specific-like 1
  Uniprot ID: Q9NUJ3
  ENSP ID: ENSP00000433067

SEQ ID NO: 87427 - protein, 595 aa, Homo sapiens
  Payload ID: 17491
  Gene Symbol: TCP11L1
  Gene Name: t-complex 11, testis-specific-like 1
  ENSP ID: ENSP00000435667
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKEIVHKAFWDCLSVQLSEDPPAYDHAIKLVGEIKETLLSFLLPGHTRLRNQITEVLDLDLIKQEAENGALDISKLAEFIIGMMGTLCAPARDEEVKKLKDIKEIVPLFREIFSVLDLMKVDMANFAISSIRPHLMQQSVEYERKKFQEILERQPNSLDFVTQWLEEASEDLMTQKYKHALPVGGMAAGSGDMPRLSPVAVQNYAYLKLLKWDHLQRPFPETVLMDQSRFHELQLQLEQLTILGAVLLVTFSMAAPGISSQADFAEKLKMIVKILLTDMHLPSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILRKRWISFGNFFGSSNTDMSPWNCRTDYPMSLHIRFPKNHVIEAPMTIQLCFQEPCNKALSLLNIPLEAKGILDRSFLQRRLKPYRIRFCCRAL

SEQ ID NO: 87428 - protein, 54 aa, Homo sapiens
  Payload ID: 17491
  Gene Symbol: TCP11L1
  Gene Name: t-complex 11, testis-specific-like 1
  ENSP ID: ENSP00000435870
MSENLDKSNVNEAGKSKSNDSEEGLEDAVEGADEALQKAIKSDSSSPQRVQRPH

SEQ ID NO: 87429 - protein, 144 aa, Homo sapiens
  Payload ID: 17491
  Gene Symbol: TCP11L1
  Gene Name: t-complex 11, testis-specific-like 1
  ENSP ID: ENSP00000436428
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKEIVHKAFWDCLSVQLSEDPPAYDHAIKLVGEIKETLLSF

SEQ ID NO: 87430 - protein, 158 aa, Homo sapiens
  Payload ID: 17491
  Gene Symbol: TCP11L1
  Gene Name: t-complex 11, testis-specific-like 1
  ENSP ID: ENSP00000436471
  MOD_RES (1)..(1): Any amino acid
XSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILISPELFNVDHRINTTSLINSSDSCYSLIFCIRSYSFPEIG

SEQ ID NO: 87431 - protein, 106 aa, Homo sapiens
  Payload ID: 17491
  Gene Symbol: TCP11L1
  Gene Name: t-complex 11, testis-specific-like 1
  ENSP ID: ENSP00000473628
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKE

SEQ ID NO: 87432 - protein, 519 aa, Homo sapiens
  Payload ID: 17492
  Gene Symbol: TCP11L2
  Gene Name: t-complex 11, testis-specific-like 2
  Uniprot ID: Q8N4U5
  ENSP ID: ENSP00000299045
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSALDQTTEWIKESVNEELFSLSESALTPGAENTSKPSLSPTLVLNNSYLKLLQWDYQKKELPETLMTDGARLQELTEKLNQLKIIACLSLITNNMVGAITGGLPELASRLTRISAVLLEGMNKETFNLKEVLNSIGIQTCVEVNKTLMERGLPTLNAEIQANLIGQFSSIEEEDNPIWSLIDKRIKLYMRRLLCLPSPQKCMPPMPGGLAVIQQELEALGSQYANIVNLNKQVYGPFYANILRKLLFNEEAMGKVDASPPTN

SEQ ID NO: 87433 - protein, 131 aa, Homo sapiens
  Payload ID: 17492
  Gene Symbol: TCP11L2
  Gene Name: t-complex 11, testis-specific-like 2
  ENSP ID: ENSP00000447174
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIK

SEQ ID NO: 87434 - protein, 17 aa, Homo sapiens
  Payload ID: 17492
  Gene Symbol: TCP11L2
  Gene Name: t-complex 11, testis-specific-like 2
  ENSP ID: ENSP00000447416
MPFNGEKQCVGEDQPSD

SEQ ID NO: 87435 - protein, 97 aa, Homo sapiens
  Payload ID: 17492
  Gene Symbol: TCP11L2
  Gene Name: t-complex 11, testis-specific-like 2
  ENSP ID: ENSP00000447457
MPFNGEKQCVGEDQPSDSDSSRFSESMASLSDYECSRQSFASDSSSKSSSPASTSPPRVVTFDEVMATARNLSNLTLAHEIAVNENFQLKQEALPEK

SEQ ID NO: 87436 - protein, 60 aa, Homo sapiens
  Payload ID: 17492
  Gene Symbol: TCP11L2
  Gene Name: t-complex 11, testis-specific-like 2
  ENSP ID: ENSP00000448064
MPFNGEKQCVGEDQPSDSDSSRFSESMASLSDYECSRQSFASDSSSKSSSPALLYEHLTA

SEQ ID NO: 87437 - protein, 234 aa, Homo sapiens
  Payload ID: 17492
  Gene Symbol: TCP11L2
  Gene Name: t-complex 11, testis-specific-like 2
  ENSP ID: ENSP00000448629
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLR

SEQ ID NO: 87438 - protein, 266 aa, Homo sapiens
  Payload ID: 17492
  Gene Symbol: TCP11L2
  Gene Name: t-complex 11, testis-specific-like 2
  Uniprot ID: Q8N4U5
  ENSP ID: ENSP00000448952
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPRKAEVAGAS

SEQ ID NO: 87439 - protein, 272 aa, Homo sapiens
  Payload ID: 17492
  Gene Symbol: TCP11L2
  Gene Name: t-complex 11, testis-specific-like 2
  ENSP ID: ENSP00000449123
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSEYNIMCIYIEIRLK

SEQ ID NO: 87440 - protein, 17 aa, Homo sapiens
  Payload ID: 17492
  Gene Symbol: TCP11L2
  Gene Name: t-complex 11, testis-specific-like 2
  ENSP ID: ENSP00000449844
MPFNGEKQCVGEDQPSD

SEQ ID NO: 87441 - protein, 198 aa, Homo sapiens
  Payload ID: 17493
  Gene Symbol: TCTE1
  Gene Name: t-complex-associated-testis-expressed 1
  ENSP ID: ENSP00000360559
MFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKDGGKQLLEGMSDNKTLLEFDLRLSDVAQESEYLIGQALYANREAARQRALNPSHFMSTITANGPENSVG

SEQ ID NO: 87442 - protein, 501 aa, Homo sapiens
  Payload ID: 17493
  Gene Symbol: TCTE1
  Gene Name: t-complex-associated-testis-expressed 1
  Uniprot ID: Q5JU00
  ENSP ID: ENSP00000360560
MQDTVTTSALLDPSHSSVSTQDNSSTGGHTSSTSPQLSKPSITPVPAKSRNPHPRANIRRMRRIIAEDPEWSLAIVPLLTELCIQHIIRNFQKNPILKQMLPEHQQKVLNHLSPDLPLAVTANLIDSENYWLRCCMHRWPVCHVAHHGGSWKRMFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKIFKLTRSKVDDDKARIIIRSLLDHPVLEELDLSQNLIGDRGARGAAKLLSHSRLRVLNLANNQVRAPGAQSLAHALAHNTNLISLNLRLNCIEDEGGQALAHALQTNKCLTTLHLGGNELSEPTATLLSQVLAINTTLTSINLSCNHIGLDGGKQLLEGMSDNKTLLEFDLRLSDVAQESEYLIGQALYANREAARQRALNPSHFMSTITANGPENSVG

SEQ ID NO: 87443 - protein, 198 aa, Homo sapiens
  Payload ID: 17494
  Gene Symbol: TCTE3
  Gene Name: t-complex-associated-testis-expressed 3
  Uniprot ID: Q8IZS6
  ENSP ID: ENSP00000355736
MEKRGRGVKSSPIQTPNQTPQQAPVTPRKERRPSMFEKEAYTQILRERLRESIHNVQYVEPPFDDSIADIGKEWKSALAKLKFANSYRMEPLKKFQAHSVETKVQQILTESLKDVKYDDKVFSHLSLELADRILLAVKEFGYHRYKFIIKVLFIQKTGQAINIASRWIWDIAWDSWVAAKHEAESYVALVLVFALYYE

SEQ ID NO: 87444 - protein, 198 aa, Homo sapiens; identical to SEQ ID NO: 87443
  Payload ID: 17494
  Gene Symbol: TCTE3
  Gene Name: t-complex-associated-testis-expressed 3
  Uniprot ID: Q8IZS6
  ENSP ID: ENSP00000478684

SEQ ID NO: 87445 - protein, 179 aa, Homo sapiens
  Payload ID: 17495
  Gene Symbol: TCTEX1D1
  Gene Name: Tctex1 domain containing 1
  Uniprot ID: Q8N7M0
  ENSP ID: ENSP00000282670
MMMSDNAKGRAAHSWKKRGSISSLSNHEFWRKEIHGRIKDSMSTVSYMEEPSQRDDISRLTVQMENTYQLGPPKHFPVVTVNHILKDVVTSYLQVEEYEPELCRQMTKTISEVIKAQVKDLMIPRYKLIVIVHIGQLNRQSILIGSRCLWDPKSDTFSSYVFRNSSLFALANVYAVYLE

SEQ ID NO: 87446 - protein, 76 aa, Homo sapiens
  Payload ID: 17495
  Gene Symbol: TCTEX1D1
  Gene Name: Tctex1 domain containing 1
  ENSP ID: ENSP00000436731
MMMSDNAKGRAAHSWKKRGSISSLSNHEFWRKEIHGRIKDSMSTVSYMEEPSQRDDISRLTVQMENTYQLAQYKGL

SEQ ID NO: 87447 - protein, 142 aa, Homo sapiens
  Payload ID: 17496
  Gene Symbol: TCTEX1D2
  Gene Name: Tctex1 domain containing 2
  Uniprot ID: Q8WW35
  ENSP ID: ENSP00000324323
MATSIGVSFSVGDGVPEAEKNAGEPENTYILRPVFQQRFRPSVVKDCIHAVLKEELANAEYSPEEMPQLTKHLSENIKDKLKEMGFDRYKMVVQVVIGEQRGEGVFMASRCFWDADTDNYTHDVFMNDSLFCVVAAFGCFYY

SEQ ID NO: 87448 - protein, 132 aa, Homo sapiens
  Payload ID: 17496
  Gene Symbol: TCTEX1D2
  Gene Name: Tctex1 domain containing 2
  ENSP ID: ENSP00000410605
MATSIGVSFSVGDGVPEAEKNAGEPENTYILRPVFQQRFRPSVVKDCIHAVLKEELANAEYSPEEMPQLTKHLSENIKDKLKEMGFDRYKMVVQVVIGEQRGEGVLLECSGMISAHCNLCLPGSSDSPASAS

SEQ ID NO: 87449 - protein, 45 aa, Homo sapiens
  Payload ID: 17496
  Gene Symbol: TCTEX1D2
  Gene Name: Tctex1 domain containing 2
  ENSP ID: ENSP00000415835
MATSIGVSFSVGDGVPEAEKNAGEPENTYILRPVFQQRRVQALCG

SEQ ID NO: 87450 - protein, 221 aa, Homo sapiens
  Payload ID: 17497
  Gene Symbol: TCTEX1D4
  Gene Name: Tctex1 domain containing 4
  Uniprot ID: Q5JR98
  ENSP ID: ENSP00000341803
MASRPLPPGRQEEENAKDSGRKPSPVRPRGCLPSIDEARPAGPGPAPASRRGSMLGLAASFSRRNSLVGPGAGPGGQRPSLGPVPPLGSRVSFSGLPLAPARWVAPSYRTEPVPGERWEAARAQRALEAALAAGLHDACYSSDEAARLVRELCEQVHVRLRELSPPRYKLVCSVVLGPRAGQGVHVVSRALWDVARDGLASVSYTNTSLFAVATVHGLYCE

SEQ ID NO: 87451 - protein, 350 aa, Homo sapiens
  Payload ID: 17498
  Gene Symbol: TGDS
  Gene Name: TDP-glucose 4,6-dehydratase
  Uniprot ID: O95455
  ENSP ID: ENSP00000261296
MSAACWEEPWGLPGGFAKRVLVTGGAGFIASHMIVSLVEDYPNYMIINLDKLDYCASLKNLETISNKQNYKFIQGDICDSHFVKLLFETEKIDIVLHFAAQTHVDLSFVRAFEFTYVNVYGTHVLVSAAHEARVEKFIYVSTDEVYGGSLDKEFDESSPKQPTNPYASSKAAAECFVQSYWEQYKFPVVITRSSNVYGPHQYPEKVIPKFISLLQHNRKCCIHGSGLQTRNFLYATDVVEAFLTVLKKGKPGEIYNIGTNFEMSVVQLAKELIQLIKETNSESEMENWVDYVNDRPTNDMRYPMKSEKIHGLGWRPKVPWKEGIKKTIEWYRENFHNWKNVEKALEPFPV

SEQ ID NO: 87452 - protein, 357 aa, Homo sapiens
  Payload ID: 17499
  Gene Symbol: TEAD1
  Gene Name: TEA domain family member 1 (SV40 transcriptional enhancer factor)
  Uniprot ID: P28347
  ENSP ID: ENSP00000334754
MERMSDSADKPIDNDAEGVWSPDIEQSFQEALAIYPPCGRRKIILSDEGKMYGRNELIARYIKLRTGKTRTRKQVSSHIQVLARRKSRDFHSKLKVTSMDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 87453 - protein, 361 aa, Homo sapiens
  Payload ID: 17499
  Gene Symbol: TEAD1
  Gene Name: TEA domain family member 1 (SV40 transcriptional enhancer factor)
  ENSP ID: ENSP00000354588
MYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 87454 - protein, 159 aa, Homo sapiens
  Payload ID: 17499
  Gene Symbol: TEAD1
  Gene Name: TEA domain family member 1 (SV40 transcriptional enhancer factor)
  ENSP ID: ENSP00000432587
  MOD_RES (1)..(1): Any amino acid
XDAPPPLHLCPERGQQPSAPAGPGAGAVLGRGGVAGPRDREPGREPGTEQRAGEAAPKFASDSPGAAVAPWAEVYFLEKAPGFGLENPTAKIEPSSWSGSESPAENMERMSDSADKPIDNDAEGVWSPDIEQSFQEALAIYPPCGRRKIILSDEGKMYG

SEQ ID NO: 87455 - protein, 426 aa, Homo sapiens
  Payload ID: 17499
  Gene Symbol: TEAD1
  Gene Name: TEA domain family member 1 (SV40 transcriptional enhancer factor)
  ENSP ID: ENSP00000435233
IEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 87456 - protein, 330 aa, Homo sapiens
  Payload ID: 17499
  Gene Symbol: TEAD1
  Gene Name: TEA domain family member 1 (SV40 transcriptional enhancer factor)
  ENSP ID: ENSP00000435393
MRYVLSWCVTVTFKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 87457 - protein, 368 aa, Homo sapiens
  Payload ID: 17499
  Gene Symbol: TEAD1
  Gene Name: TEA domain family member 1 (SV40 transcriptional enhancer factor)
  ENSP ID: ENSP00000435977
IEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 87458 - protein, 447 aa, Homo sapiens
  Payload ID: 17500
  Gene Symbol: TEAD2
  Gene Name: TEA domain family member 2
  Uniprot ID: Q15562
  ENSP ID: ENSP00000310701
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 87459 - protein, 450 aa, Homo sapiens
  Payload ID: 17500
  Gene Symbol: TEAD2
  Gene Name: TEA domain family member 2
  Uniprot ID: Q15562
  ENSP ID: ENSP00000366419
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQVVQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 87460 - protein, 319 aa, Homo sapiens
  Payload ID: 17500
  Gene Symbol: TEAD2
  Gene Name: TEA domain family member 2
  Uniprot ID: Q15562
  ENSP ID: ENSP00000437928
MATMSSAQLISAPSLQAKLGPTGPQVVQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 87461 - protein, 451 aa, Homo sapiens
  Payload ID: 17500
  Gene Symbol: TEAD2
  Gene Name: TEA domain family member 2
  Uniprot ID: Q15562
  ENSP ID: ENSP00000469640
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKALNVDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 87462 - protein, 450 aa, Homo sapiens; identical to SEQ ID NO: 87459
  Payload ID: 17500
  Gene Symbol: TEAD2
  Gene Name: TEA domain family member 2
  Uniprot ID: Q15562
  ENSP ID: ENSP00000469672

SEQ ID NO: 87463 - protein, 74 aa, Homo sapiens
  Payload ID: 17500
  Gene Symbol: TEAD2
  Gene Name: TEA domain family member 2
  ENSP ID: ENSP00000471743
  MOD_RES (1)..(1): Any amino acid
XKDQVSKDKAFQTMATMSSAQLISAPSLQAKLGPTGPQVVQASELFQFWSGGSGPPWNVPEKKLLPRSPPADFP

SEQ ID NO: 87464 - protein, 451 aa, Homo sapiens; identical to SEQ ID NO: 87461
  Payload ID: 17500
  Gene Symbol: TEAD2
  Gene Name: TEA domain family member 2
  Uniprot ID: Q15562
  ENSP ID: ENSP00000472109

SEQ ID NO: 87465 - protein, 116 aa, Homo sapiens
  Payload ID: 17500
  Gene Symbol: TEAD2
  Gene Name: TEA domain family member 2
  ENSP ID: ENSP00000472397
MATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQ

SEQ ID NO: 87466 - protein, 435 aa, Homo sapiens
  Payload ID: 17501
  Gene Symbol: TEAD3
  Gene Name: TEA domain family member 3
  Uniprot ID: Q99594
  ENSP ID: ENSP00000345772
IASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 87467 - protein, 375 aa, Homo sapiens
  Payload ID: 17501
  Gene Symbol: TEAD3
  Gene Name: TEA domain family member 3
  ENSP ID: ENSP00000384577
MGPRAWTRGWTTMRRACGARTSSRASRRPWPSTRPAAGGRSSCQTRARCTAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 87468 - protein, 219 aa, Homo sapiens
  Payload ID: 17501
  Gene Symbol: TEAD3
  Gene Name: TEA domain family member 3
  ENSP ID: ENSP00000416400
VSSHLQVLARRKSREIQSKLKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQ

SEQ ID NO: 87469 - protein, 391 aa, Homo sapiens
  Payload ID: 17502
  Gene Symbol: TEAD4
  Gene Name: TEA domain family member 4
  ENSP ID: ENSP00000351184
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 87470 - protein, 434 aa, Homo sapiens
  Payload ID: 17502
  Gene Symbol: TEAD4
  Gene Name: TEA domain family member 4
  ENSP ID: ENSP00000352926
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 87471 - protein, 305 aa, Homo sapiens
  Payload ID: 17502
  Gene Symbol: TEAD4
  Gene Name: TEA domain family member 4
  Uniprot ID: Q15561
  ENSP ID: ENSP00000380311
MAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 87472 - protein, 110 aa, Homo sapiens
  Payload ID: 17502
  Gene Symbol: TEAD4
  Gene Name: TEA domain family member 4
  ENSP ID: ENSP00000411475
LEGTAGTITSNEWSSPTSPEGSTASGGSQALDKPIDNDAEGVWSPDIEQSFQEALAIYPPCGRRKIILSDEGKMYGLQPHPGAGSSQSSRDPGQAKVLARSFARPSRNVP

SEQ ID NO: 87473 - protein, 72 aa, Homo sapiens
  Payload ID: 17502
  Gene Symbol: TEAD4
  Gene Name: TEA domain family member 4
  ENSP ID: ENSP00000438453
LEGTAGTITSNEWSSPTSPEGSTASGGSQALDKPIDNDAEGVWSPDIEQSFQEALAIYPPCGRRKIILSDEG

SEQ ID NO: 87474 - protein, 22 aa, Homo sapiens
  Payload ID: 17502
  Gene Symbol: TEAD4
  Gene Name: TEA domain family member 4
  ENSP ID: ENSP00000438960
LEGTAGTITSNEWSSPTSPEGS

SEQ ID NO: 87475 - protein, 189 aa, Homo sapiens
  Payload ID: 17502
  Gene Symbol: TEAD4
  Gene Name: TEA domain family member 4
  ENSP ID: ENSP00000441959
  MOD_RES (1)..(1): Any amino acid
XGKTRTRKQVSSHIQVLARRKAREIQAKLKTGAELGTCGREDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVD

SEQ ID NO: 87476 - protein, 175 aa, Homo sapiens
  Payload ID: 17502
  Gene Symbol: TEAD4
  Gene Name: TEA domain family member 4
  ENSP ID: ENSP00000444528
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSH

SEQ ID NO: 87477 - protein, 1032 aa, Homo sapiens
  Payload ID: 17503
  Gene Symbol: TSHZ1
  Gene Name: teashirt zinc finger homeobox 1
  Uniprot ID: Q6ZSZ6
  ENSP ID: ENSP00000323584
MCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 87478 - protein, 78 aa, Homo sapiens
  Payload ID: 17503
  Gene Symbol: TSHZ1
  Gene Name: teashirt zinc finger homeobox 1
  ENSP ID: ENSP00000452718
MCNEETEIKEAQSYQNSPVSSATNQDAGYGSPFSESSDQLAHFKGSSSREEKEDPQCPDSVSYPQDSLAQIKAVYANL

SEQ ID NO: 87479 - protein, 276 aa, Homo sapiens
  Payload ID: 17503
  Gene Symbol: TSHZ1
  Gene Name: teashirt zinc finger homeobox 1
  ENSP ID: ENSP00000453834
MCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQD

SEQ ID NO: 87480 - protein, 1077 aa, Homo sapiens
  Payload ID: 17503
  Gene Symbol: TSHZ1
  Gene Name: teashirt zinc finger homeobox 1
  Uniprot ID: Q6ZSZ6
  ENSP ID: ENSP00000464391
MPRRKQQAPRRSAAYVPEEELKAAEIDEEHVEDDGLSLDIQESEYMCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 87481 - protein, 1031 aa, Homo sapiens
  Payload ID: 17504
  Gene Symbol: TSHZ2
  Gene Name: teashirt zinc finger homeobox 2
  Uniprot ID: Q9NRE2
  ENSP ID: ENSP00000333114
MMAAALLHYTGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 87482 - protein, 1034 aa, Homo sapiens
  Payload ID: 17504
  Gene Symbol: TSHZ2
  Gene Name: teashirt zinc finger homeobox 2
  Uniprot ID: Q9NRE2
  ENSP ID: ENSP00000360552
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 87483 - protein, 194 aa, Homo sapiens
  Payload ID: 17504
  Gene Symbol: TSHZ2
  Gene Name: teashirt zinc finger homeobox 2
  ENSP ID: ENSP00000474159
RKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 87484 - protein, 1031 aa, Homo sapiens; identical to SEQ ID NO: 87481
  Payload ID: 17504
  Gene Symbol: TSHZ2
  Gene Name: teashirt zinc finger homeobox 2
  Uniprot ID: Q9NRE2
  ENSP ID: ENSP00000475114

SEQ ID NO: 87485 - protein, 74 aa, Homo sapiens
  Payload ID: 17504
  Gene Symbol: TSHZ2
  Gene Name: teashirt zinc finger homeobox 2
  ENSP ID: ENSP00000487408
MKFQECHSEVMRHGQKIYPSHHRIEMAVEIASLKCQHSSINQSPTRKNSNSTTGWLLWDLLMGIGNSGSNVVLT

SEQ ID NO: 87486 - protein, 1081 aa, Homo sapiens
  Payload ID: 17505
  Gene Symbol: TSHZ3
  Gene Name: teashirt zinc finger homeobox 3
  Uniprot ID: Q63HK5
  ENSP ID: ENSP00000240587
MPRRKQQAPRRAAAYVSEELKAAALVDEGLDPEEHTADGEPSAKYMCPEKELARACPSYQNSPAAEFSCHEMDSESHISETSDRMADFESGSIKNEEETKEVTVPLEDTTVSDSLEQMKAVYNNFLSNSYWSNLNLNLHQPSSEKNNGSSSSSSSSSSSCGSGSFDWHQSAMAKTLQQVSQSRMLPEPSLFSTVQLYRQSSKLYGSIFTGASKFRCKDCSAAYDTLVELTVHMNETGHYRDDNHETDNNNPKRWSKPRKRSLLEMEGKEDAQKVLKCMYCGHSFESLQDLSVHMIKTKHYQKVPLKEPVTPVAAKIIPATRKKASLELELPSSPDSTGGTPKATISDTNDALQKNSNPYITPNNRYGHQNGASYAWHFEARKSQILKCMECGSSHDTLQELTAHMMVTGHFIKVTNSAMKKGKPIVETPVTPTITTLLDEKVQSVPLAATTFTSPSNTPASISPKLNVEVKKEVDKEKAVTDEKPKQKDKPGEEEEKCDISSKYHYLTENDLEESPKGGLDILKSLENTVTSAINKAQNGTPSWGGYPSIHAAYQLPNMMKLSLGSSGKSTPLKPMFGNSEIVSPTKNQTLVSPPSSQTSPMPKTNFHAMEELVKKVTEKVAKVEEKMKEPDGKLSPPKRATPSPCSSEVGEPIKMEASSDGGFRSQENSPSPPRDGCKDGSPLAEPVENGKELVKPLASSLSGSTAIITDHPPEQPFVNPLSALQSVMNIHLGKAAKPSLPALDPMSMLFKMSNSLAEKAAVATPPPLQSKKADHLDRYFYHVNNDQPIDLTKGKSDKGCSLGSVLLSPTSTAPATSSSTVTTAKTSAVVSFMSNSPLRENALSDISDMLKNLTESHTSKSSTPSSISEKSDIDGATLEEAEESTPAQKRKGRQSNWNPQHLLILQAQFAASLRQTSEGKYIMSDLSPQERMHISRFTGLSMTTISHWLANVKYQLRRTGGTKFLKNLDTGHPVFFCNDCASQIRTPSTYISHLESHLGFRLRDLSKLSTEQINSQIAQTKSPSEKMVTSSPEEDLGTSYQCKLCNRTFASKHAVKLHLSKTHGKSPEDHLLYVSELEKQ

SEQ ID NO: 87487 - protein, 33 aa, Homo sapiens
  Payload ID: 17505
  Gene Symbol: TSHZ3
  Gene Name: teashirt zinc finger homeobox 3
  ENSP ID: ENSP00000475613
MPRRKQQAPRRAADKSINWVEVLSTWWVENVLP

SEQ ID NO: 87488 - protein, 631 aa, Homo sapiens
  Payload ID: 17506
  Gene Symbol: TEC
  Gene Name: tec protein tyrosine kinase
  Uniprot ID: P42680
  ENSP ID: ENSP00000370912
MNFNTILEEILIKRSQQKKKTSPLNYKERLFVLTKSMLTYYEGRAEKKYRKGFIDVSKIKCVEIVKNDDGVIPCQNKYPFQVVHDANTLYIFAPSPQSRDLWVKKLKEEIKNNNNIMIKYHPKFWTDGSYQCCRQTEKLAPGCEKYNLFESSIRKALPPAPETKKRRPPPPIPLEEEDNSEEIVVAMYDFQAAEGHDLRLERGQEYLILEKNDVHWWRARDKYGNEGYIPSNYVTGKKSNNLDQYEWYCRNMNRSKAEQLLRSEDKEGGFMVRDSSQPGLYTVSLYTKFGGEGSSGFRHYHIKETTTSPKKYYLAEKHAFGSIPEIIEYHKHNAAGLVTRLRYPVSVKGKNAPTTAGFSYEKWEINPSELTFMRELGSGLFGVVRLGKWRAQYKVAIKAIREGAMCEEDFIEEAKVMMKLTHPKLVQLYGVCTQQKPIYIVTEFMERGCLLNFLRQRQGHFSRDVLLSMCQDVCEGMEYLERNSFIHRDLAARNCLVSEAGVVKVSDFGMARYVLDDQYTSSSGAKFPVKWCPPEVFNYSRFSSKSDVWSFGVLMWEVFTEGRMPFEKYTNYEVVTMVTRGHRLYQPKLASNYVYEVMLRCWQEKPEGRPSFEDLLRTIDELVECEETFGR

SEQ ID NO: 87489 - protein, 51 aa, Homo sapiens
  Payload ID: 17506
  Gene Symbol: TEC
  Gene Name: tec protein tyrosine kinase
  ENSP ID: ENSP00000424365
MRELGSGLFGVVRLGKWRAQYKVAIKAIREGAMCEEDFIEEAKVMMLPEIV

SEQ ID NO: 87490 - protein, 100 aa, Homo sapiens
  Payload ID: 17506
  Gene Symbol: TEC
  Gene Name: tec protein tyrosine kinase
  ENSP ID: ENSP00000424567
MNFNTILEEILIKRSQQKKKTSPLNYKERLFVLTKSMLTYYEGRAEKKYRKGFIDVSKIKCVEIVKNDDGVIPCQNKYPFQSTKQGPVGEEVKRRNKEQQ

SEQ ID NO: 87491 - protein, 483 aa, Homo sapiens [sequence omitted]

SEQ ID NO: 87492 - protein, 573 aa, Homo sapiens
  Payload ID: 17507
  Gene Symbol: TCTN1
  Gene Name: tectonic family member 1
  Uniprot ID: Q2MV58
  ENSP ID: ENSP00000380775
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLEVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 87493 - protein, 179 aa, Homo sapiens
  Payload ID: 17507
  Gene Symbol: TCTN1
  Gene Name: tectonic family member 1
  ENSP ID: ENSP00000380776
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNSHFTPGLSRWLCESRSRILSFP

SEQ ID NO: 87494 - protein, 592 aa, Homo sapiens
  Payload ID: 17507
  Gene Symbol: TCTN1
  Gene Name: tectonic family member 1
  Uniprot ID: Q2MV58
  ENSP ID: ENSP00000380779
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKHFVLQDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 87495 - protein, 100 aa, Homo sapiens
  Payload ID: 17507
  Gene Symbol: TCTN1
  Gene Name: tectonic family member 1
  ENSP ID: ENSP00000435027
MRPRGLPPLLVVLLGCWASVSAQTDATPAVTTEGLNSTEAALATFGTFPSTRPPGTPRAPGPSSGPRPTPVTDGGYHVPAPGVHSDPTSRGQPRCCSLCL

SEQ ID NO: 87496 - protein, 83 aa, Homo sapiens
  Payload ID: 17507
  Gene Symbol: TCTN1
  Gene Name: tectonic family member 1
  ENSP ID: ENSP00000436044
MRPRGLPPLLVVLLGCWASVSAQTDATPAVTTEGLNSTEAALATFGTFPSTRPPGTPRAPGPSSGPRPTPVTDGSHSVTQAGV

SEQ ID NO: 87497 - protein, 100 aa, Homo sapiens; identical to SEQ ID NO: 87495
  Payload ID: 17507
  Gene Symbol: TCTN1
  Gene Name: tectonic family member 1
  ENSP ID: ENSP00000436673

SEQ ID NO: 87498 - protein, 263 aa, Homo sapiens
  Payload ID: 17507
  Gene Symbol: TCTN1
  Gene Name: tectonic family member 1
  ENSP ID: ENSP00000437196
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLERFW

SEQ ID NO: 87499 - protein, 94 aa, Homo sapiens
  Payload ID: 17507
  Gene Symbol: TCTN1
  Gene Name: tectonic family member 1
  ENSP ID: ENSP00000448188
DTDVLQPTLVNAGHFSLCVNVVLETDWSSPVSARSTEGEEPAVGPGLPRLRGPFWKFPGPGHAGLGAHPLHHPVIQQEGFLPAPRGFGYRSEVD

SEQ ID NO: 87500 - protein, 587 aa, Homo sapiens
  Payload ID: 17507
  Gene Symbol: TCTN1
  Gene Name: tectonic family member 1
  Uniprot ID: Q2MV58
  ENSP ID: ENSP00000448735
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 87501 - protein, 72 aa, Homo sapiens
  Payload ID: 17507
  Gene Symbol: TCTN1
  Gene Name: tectonic family member 1
  ENSP ID: ENSP00000450154
MKGRFLFPLRLLLWMCLHLQRQASELHQPSMPGCPLTSSSRLFDNAQMHQFLNIHVKFENCTFGEIKFYIQL

SEQ ID NO: 87502 - protein, 88 aa, Homo sapiens
  Payload ID: 17507
  Gene Symbol: TCTN1
  Gene Name: tectonic family member 1
  ENSP ID: ENSP00000473743
MRPRGLPPLLVVLLGCWASVSAQTDATPAVTTEGLNSTEAALATFGTFPSTRPPGTPRAPGPSSGPRPTPVTDGATASFVVKKQSSIH

SEQ ID NO: 87503 - protein, 245 aa, Homo sapiens
  Payload ID: 17507
  Gene Symbol: TCTN1
  Gene Name: tectonic family member 1
  ENSP ID: ENSP00000473789
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEVSLNLIDSFHPITNIFPCKLIFKVTRKTGFLETELIL

SEQ ID NO: 87504 - protein, 162 aa, Homo sapiens
  Payload ID: 17507
  Gene Symbol: TCTN1
  Gene Name: tectonic family member 1
  ENSP ID: ENSP00000473903
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNCRCSV

SEQ ID NO: 87505 - protein, 100 aa, Homo sapiens; identical to SEQ ID NO: 87495
  Payload ID: 17507
  Gene Symbol: TCTN1
  Gene Name: tectonic family member 1
  ENSP ID: ENSP00000474208

SEQ ID NO: 87506 - protein, 106 aa, Homo sapiens
  Payload ID: 17507
  Gene Symbol: TCTN1
  Gene Name: tectonic family member 1
  ENSP ID: ENSP00000474291
MRPRGLPPLLVVLLGCWASVSAQTDATPAVTTEGLNSTEAALATFGTFPSTRPPGTPRAPGPSSGPRPTPVTDGHATCRYRSRRLTVSGELDGKLQVASGSVGGEE

SEQ ID NO: 87507 - protein, 88 aa, Homo sapiens; identical to SEQ ID NO: 87502
  Payload ID: 17507
  Gene Symbol: TCTN1
  Gene Name: tectonic family member 1
  ENSP ID: ENSP00000474343

SEQ ID NO: 87508 - protein, 75 aa, Homo sapiens
  Payload ID: 17507
  Gene Symbol: TCTN1
  Gene Name: tectonic family member 1
  ENSP ID: ENSP00000474525
MRPRGLPPLLVVLLGCWASVSAQTDATPAVTTEGLNSTEAALATFGTFPSTRPPGTPRAPGPSSGPRPTPVTDGG

SEQ ID NO: 87509 - protein, 573 aa, Homo sapiens [sequence omitted]

SEQ ID NO: 87510 - protein, 697 aa, Homo sapiens
  Payload ID: 17508
  Gene Symbol: TCTN2
  Gene Name: tectonic family member 2
  Uniprot ID: Q96GX1
  ENSP ID: ENSP00000304941
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQCVAKGLLLLLFLTLALFLSNPWTRICKAYS

SEQ ID NO: 87511 - protein, 696 aa, Homo sapiens
  Payload ID: 17508
  Gene Symbol: TCTN2
  Gene Name: tectonic family member 2
  Uniprot ID: Q96GX1
  ENSP ID: ENSP00000395171
MGFQPPAALLLRLFLLQGILRLLWGDLAFIPPFIRMSGPAVSASLVGDTEGVTVSLAVLQDEAGILPIPTCGVLNNETEDWSVTVIPGAVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQCVAKGLLLLLFLTLALFLSNPWTRICKAYS

SEQ ID NO: 87512 - protein, 60 aa, Homo sapiens
  Payload ID: 17508
  Gene Symbol: TCTN2
  Gene Name: tectonic family member 2
  ENSP ID: ENSP00000437644
MGFQPPAALLLRLFLLQGILRLLWGDLGVYGAAVTSLSSLLLSECPALRSARPWSETPRV

SEQ ID NO: 87513 - protein, 625 aa, Homo sapiens
  Payload ID: 17509
  Gene Symbol: TCTN3
  Gene Name: tectonic family member 3
  ENSP ID: ENSP00000265993
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 87514 - protein, 443 aa, Homo sapiens
  Payload ID: 17509
  Gene Symbol: TCTN3
  Gene Name: tectonic family member 3
  Uniprot ID: Q6NUS6
  ENSP ID: ENSP00000360253
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSVSFLELGGLLQPNEKSCKGFQTYVRLAKGEEFFVHYNEVLIY

SEQ ID NO: 87515 - protein, 607 aa, Homo sapiens
  Payload ID: 17509
  Gene Symbol: TCTN3
  Gene Name: tectonic family member 3
  Uniprot ID: Q6NUS6
  ENSP ID: ENSP00000360261
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 87516 - protein, 459 aa, Homo sapiens
  Payload ID: 17509
  Gene Symbol: TCTN3
  Gene Name: tectonic family member 3
  Uniprot ID: Q6NUS6
  ENSP ID: ENSP00000387567
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNCFLESKSTTCTRFFKNLASSCTLDSALNAASYYNFTVLKVPRSMTDPQNMEAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 87517 - protein, 607 aa, Homo sapiens; identical to SEQ ID NO: 87515
  Payload ID: 17509
  Gene Symbol: TCTN3
  Gene Name: tectonic family member 3
  Uniprot ID: Q6NUS6
  ENSP ID: ENSP00000483364

SEQ ID NO: 87518 - protein, 96 aa, Homo sapiens
  Payload ID: 17510
  Gene Symbol: TECPR1
  Gene Name: tectonin beta-propeller repeat containing 1
  ENSP ID: ENSP00000396076
MPNSVLWAVDLFGRVYTLSTAGQYWEMCKDSQLEFKRVSATTQCCWGIACDNQVYVYVCASDVPIRRREEAYENQAWVQGRLCVPGPQRWNPMGGF

SEQ ID NO: 87519 - protein, 1165 aa, Homo sapiens
  Payload ID: 17510
  Gene Symbol: TECPR1
  Gene Name: tectonin beta-propeller repeat containing 1
  Uniprot ID: Q7Z6L1
  ENSP ID: ENSP00000404923
MPNSVLWAVDLFGRVYTLSTAGQYWEMCKDSQLEFKRVSATTQCCWGIACDNQVYVYVCASDVPIRRREEAYENQRWNPMGGFCEKLLLSDRWGWSDVSGLQHRPLDRVALPSPHWEWESDWYVDENFGGEPTEKGGWTYAIDFPATYTKDKKWNSCVRRRKWIRYRRYKSRDIWAKIPSKDDPKELPDPFNDLSVGGWEITEEPVGRLSVWAVSLQGKVWYREDVSHSNPEGSSWSLLDTPGEVVQISCGPHDLLWATLWEGQALVREGINRSNPKGSSWSIVEPPGSENGVMHISVGVSVVWAVTKDWKVWFRRGVNSHNPCGTSWIEMVGEMTMVNVGMNDQVWGIGCEDRAVYFRQGVTPSELSGKTWKAIIAARECDRSHSGSSSSLLSAGCFFGDEVRGSGESAPSDTDASSEVERPGPGQILPAEPLDDSKNATGNSASGLGAGRTAEDTVEDACPAEGSREARPNTHPGPAPTPAELPWTNIDLKEAKKVPSHSAAGFPETTSLSSLGLLPLGLEEPYGVDDHPLWAWVSGGGCVVEACAMPRWFTVQAGLSSSVHMLSLSITPAQTAAWRKQIFQQLTERTKRELENFRHYEQAVEQSVWVKTGALQWWCDWKPHKWVDVRLALEQFTGHDGVRDSILFIYYVVHEEKKYIHIFLNEVVALVPVLNETKHSFALYTPERTRQRWPVRLAAATEQDMNDWLALLSLSCCESRKVQGRPSPQAIWSITCKGDIFVSEPSPDLEAHEHPLPCDQMFWRQMGGHLRMVEANSRGVVWGIGYDHTAWVYTGGYGGGCFQGLASSTSNIYTQSDVKCVHIYENQRWNPVTGYTSRGLPTDRYMWSDASGLQECTKAGTKPPSLQWAWVSDWFVDFSVPGGTDQEGWQYASDFPASYHGSKTMKDFVRRRCWARKCKLVTSGPWLEVPPIALRDVSIIPESPGAEGSGHSIALWAVSDKGDVLCRLGVSELNPAGSSWLHVGTDQPFASISIGACYQVWAVARDGSAFYRGSVYPSQPAGDCWYHIPSPPRQRLKQVSAGQTSVYALDENGNLWYRQGITPSYPQGSSWEHVSNNVCRVSVGPLDQVWVIANKVQGSHSLSRGTVCHRTGVQPHEPKGHGWDYGIGGGWDHISVRANATRAPRSSSQEQEPSAPPEAHGPVCC

SEQ ID NO: 87520 - protein, 101 aa, Homo sapiens
  Payload ID: 17510
  Gene Symbol: TECPR1
  Gene Name: tectonin beta-propeller repeat containing 1
  ENSP ID: ENSP00000407471
MPNSVLWAVDLFGRVYTLSTAGQYWEMCKDSQLEFKRVSATTQCCWGIACDNQVYVYVCASDVPIRRREEAYENQRWNPMGGFCEKLLLSDRWGWSDVSGL

SEQ ID NO: 87521 - protein, 99 aa, Homo sapiens
  Payload ID: 17510
  Gene Symbol: TECPR1
  Gene Name: tectonin beta-propeller repeat containing 1
  ENSP ID: ENSP00000412675
MPNSVLWAVDLFGRVYTLSTAGQYWEMCKDSQLEFKRVSATTQCCWGIACDNQVYVYVCASDVPIRRREEAYENQAWVQGRLCVPGPQRWNPMGGFCEK

SEQ ID NO: 87522 - protein, 1411 aa, Homo sapiens
  Payload ID: 17511
  Gene Symbol: TECPR2
  Gene Name: tectonin beta-propeller repeat containing 2
  Uniprot ID: O15040
  ENSP ID: ENSP00000352510
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATVAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTQLPFQEQDSSPGAHDGEDIQPIGPQSTFCEVPLLNSLTVPSSLSWAPSAEQWLPGTRADEGSPVEPSQEQDILTSMEASGHLSTNLWHAVTDDDTGQKEIPISERVLGSVGGQLTPVSALAASTHKPWLEQPPRDQTLTSSDEEDIYAHGLPSSSSETSVTELGPSCSQQDLSRLGAEDAGLLKPDQFAESWMGYSGPGYGILSLVVSEKYIWCLDYKGGLFCSALPGAGLRWQKFEDAVQQVAVSPSGALLWKIEQKSNRAFACGKVTIKGKRHWYEALPQAVFVALSDDTAWIIRTSGDLYLQTGLSVDRPCARAVKVDCPYPLSQITARNNVVWALTEQRALLYREGVSSFCPEGEQWKCDIVSERQALEPVCITLGDQQTLWALDIHGNLWFRTGIISKKPQGDDDHWWQVSITDYVVFDQCSLFQTIIHATHSVATAAQAPVEKVADKLRMAFWSQQLQCQPSLLGVNNSGVWISSGKNEFHVAKGSLIGTYWNHVVPRGTASATKWAFVLASAAPTKEGSFLWLCQSSKDLCSVSAQSAQSRPSTVQLPPEAEMRAYAACQDALWALDSLGQVFIRTLSKSCPTGMHWTRLDLSQLGAVKLTSLACGNQHIWACDSRGGVYFRVGTQPLNPSLMLPAWIMIEPPVQPAGVSLVSVHSSPNDQMLWVLDSRWNVHVRTGITEEMPVGTAWEHVPGLQACQLALSTRTVWARCPNGDLARRYGVTDKNPAGDYWKKIPGSVSCFTVTASDELWAVGPPGYLLQRLTKTFSHSHGTQKSSQAAMPHPEDLEDEWEVI

SEQ ID NO: 87523 - protein, 1267 aa, Homo sapiens
  Payload ID: 17511
  Gene Symbol: TECPR2
  Gene Name: tectonin beta-propeller repeat containing 2
  Uniprot ID: O15040
  ENSP ID: ENSP00000453671
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATVAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTQLPFQEQDSSPGAHDGEDIQPIGPQSTFCEVPLLNSLTVPSSLSWAPSAEQWLPGTRADEGSPVEPSQEQDILTSMEASGHLSTNLWHAVTDDDTGQKEIPISERVLGSVGGQLTPVSALAASTHKPWLEQPPRDQTLTSSDEEDIYAHGLPSSSSETSVTELGPSCSQQDLSRLGAEDAGLLKPDQFAESWMGYSGPGYGILSLVVSEKYIWCLDYKGGLFCSALPGAGLRWQKFEDAVQQVAVSPSGALLWKIEQKSNRAFACGKVTIKGKRHWYEALPQAVFVALSDDTAWIIRTSGDLYLQTGLSVDRPCARAVKVDCPYPLSQITARNNVVWALTEQRALLYREGVSSFCPEGEQWKCDIVSERQALEPVCITLGDQQTLWALDIHGNLWFRTGIISKKPQGDDDHWWQVSITDYVVFDQCSLFQTIIHATHSVATAAQAPVEKVADKLRMAFWSQQLQCQPSLLGVNNSGVWISSGKNEFHVAKGSLIGTYWNHVVPRGTASATKWAFVLASAAPTKEGSFLWLCQSSKDLCSVSAQSAQSRPSTVQLPPEAEMRAYAACQDALWALDSLGQVFIRTLSKSCPTGMHWTRLDLSQLGAVKLTSLACGNQHIWACDSRGGVYFRVGTQPLNPSLMLPAWIMIEPPVQVSRS

SEQ ID NO: 87524 - protein, 2155 aa, Homo sapiens
  Payload ID: 17512
  Gene Symbol: TECTA
  Gene Name: tectorin alpha
  Uniprot ID: O75443
  ENSP ID: ENSP00000264037
MNYSSFLRIWVSFIFALVQHQAQPRELMYPFWQNDTKTPKVDDGSSSEIKLAIPVFFFGVPYRTVYVNNNGVVSFNVLVSQFTPESFPLTDGRAFVAPFWADVHNGIRGEIYYRETMEPAILKRATKDIRKYFKDMATFSATWVFIVTWEEVTFYGGSSTTPVNTFQAVLVSDGSYTFTLFNYYEINWTTGTASGGDPLTGLGGVMAQAGFNGGNLTNFFSLPGSRTPEIVNIQETTNVNVPGRWAFKVDGKEIDPANGCTSRGQFLRRGEVFWDDLNCTVKCRCLDFNNEIYCQEASCSPYEVCEPKGKFFYCSAVETSTCVVFGEPHYHTFDGFLFHFQGSCAYLLARQCLQTSSLPFFSVEAKNEHRRGSAVSWVKELSVEVNGYKILIPKGSYGRVKVNDLVTSLPVTLDLGTVKIYQSGISTAVETDFGLLVTFDGQHYASISVPGSYINSTCGLCGNYNKNPLDDFLRPDGRPAMSVLDLGESWRVYHADWKCDSGCVDNCTQCDAATEALYFGSDYCGFLNKTDGPLWECGTVVDPTAFVHSCVYDLCSVRDNGTLLCQAIQAYALVCQALGIPIGDWRTQTGCVSTVQCPSFSHYSVCTSSCPDTCSDLTASRNCATPCTEGCECNQGFVLSTSQCVPLHKCGCDFDGHYYTMGEFFWATANCTVQCLCEEGGDVYCFNKTCGSGEVCAVEDGYQGCFPKRETVCLLSQNQVLHTFDGASYAFPSEFSYTLLKTCPERPEYLEIDINKKKPDAGPAWLRGLRILVADQEVKIGGIGASEVKLNGQEVELPFFHPSGKLEIYRNKNSTTVESKGVVTVQYSDIGLLYIRLSTTYFNCTGGLCGFYNANASDEFCLPNGKCTDNLAVFLESWTTFEEICNGECGDLLKACNNDSELLKFYRSRSRCGIINDPSNSSFLECHGVVNVTAYYRTCLFRLCQSGGNESELCDSVARYASACKNADVEVGPWRTYDFCPLECPENSHFEECITCTETCETLTLGPICVDSCSEGCQCDEGYALLGSQCVTRSECGCNFEGHQLATNETFWVDLDCQIFCYCSGTDNRVHCETIPCKDDEYCMEEGGLYYCQARTDASCIVSGYGHYLTFDGFPFDFQTSCPLILCTTGSRPSSDSFPKFVVTAKNEDRDPSLALWVKQVDVTVFGYSIVIHRAYKHTVLVNSERLYLPLKLGQGKINIFSFGFHVVVETDFGLKVVYDWKTFLSITVPRSMQNSTYGLCGRYNGNPDDDLEMPMGLLASSVNEFGQSWVKRDTFCQVGCGDRCPSCAKVEGFSKVQQLCSLIPNQNAAFSKCHSKVNPTFFYKNCLFDSCIDGGAVQTACSWLQNYASTCQTQGITVTGWRNYTSCTVTCPPNSHYESCVSVCQPRCAAIRLKSDCSHYCVEGCHCDAGYVLNGKSCILPHSCGCYSDGKYYEPKQLFWNSDCTRRCRCFRRNVIQCDPRQCKSDEECALRNGVRGCFSTKTSYCLAAGGGVFRTFDGAFLRFPANCAFVLSTICQKLPDISFQLIINFDKWSAPNLTIISPVYFYINEEQILINDRNTVKVNGTQVNVPFITGLATKIYSSEGFLVIDTSPDIQIYYNGFNVIKISISERLQNKVCGLCGNFNGDLTDDYVTLRGKPVVSSVVLAQSWKTNGMQKRPLAPSCNELQFSQYAAMCDNVHIQKMQGDGYCLKLTDMKGFFQPCYGLLDPLPFYESCYLDGCYSHKKFQLCGSLAAYGEACRSFGILSTEWIEKENCSGVVEDPCVGADCPNRTCELGNGRELCGCIEPPPYGNNSHDIIDAEVTCKAAQMEVSISKCKLFQLGFEREGVRINDRQCTGIEGEDFISFQINNTKGNCGNIVQSNGTHIMYKNTLWIESANNTGNIITRDRTINVEFSCAYELDIKISLDSVVKPMLSVINLTVPTQEGSFITKMALYKNASYKHPYRQGEVVLTTRDVLYVGVFVVGADATHLILTLNKCYATPTRDSNDKLRYFIIEGGCQNLKDNTIGIEENAVSLTCRFHVTVFKFIGDYDEVHLHCAVSLCDSEKYSCKITCPHNSRIATDYTKEPKEQIISVGPIRRKRLDWCEDNGGCEQICTSRVDGPLCSCVTGTLQEDGKSCRASNSSMELQVWTLLLIMIQISLWHFVYKSGTTS

SEQ ID NO: 87525 - protein, 2155 aa, Homo sapiens; identical to SEQ ID NO: 87524
  Payload ID: 17512
  Gene Symbol: TECTA
  Gene Name: tectorin alpha
  Uniprot ID: O75443
  ENSP ID: ENSP00000376543

SEQ ID NO: 87526 - protein, 329 aa, Homo sapiens
  Payload ID: 17513
  Gene Symbol: TECTB
  Gene Name: tectorin beta
  Uniprot ID: Q96PL2
  ENSP ID: ENSP00000358430
MVTKAFVLLAIFAEASAKSCAPNKADVILVFCYPKTIITKIPECPYGWEVHQLALGGLCYNGVHEGGYYQFVIPDLSPKNKSYCGTQSEYKPPIYHFYSHIVSNDTTVIVKNQPVNYSFSCTYHSTYLVNQAAFDQRVATVHVKNGSMGTFESQLSLNFYTNAKFSIKKEAPFVLEASEIGSDLFAGVEAKGLSIRFKVVLNSCWATPSADFMYPLQWQLINKGCPTDETVLVHENGRDHRATFQFNAFRFQNIPKLSKVWLHCETFICDSEKLSCPVTCDKRKRLLRDQTGGVLVVELSLRSRGFSSLYSFSDVLHHLIMMLGICAVL

SEQ ID NO: 87527 - protein, 1124 aa, Homo sapiens
  Payload ID: 17514
  Gene Symbol: TEK
  Gene Name: TEK tyrosine kinase, endothelial
  Uniprot ID: Q02763
  ENSP ID: ENSP00000369375
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 87528 - protein, 1081 aa, Homo sapiens
  Payload ID: 17514
  Gene Symbol: TEK
  Gene Name: TEK tyrosine kinase, endothelial
  Uniprot ID: Q02763
  ENSP ID: ENSP00000383977
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 87529 - protein, 468 aa, Homo sapiens
  Payload ID: 17514
  Gene Symbol: TEK
  Gene Name: TEK tyrosine kinase, endothelial
  ENSP ID: ENSP00000428337
MDSLASLVLCGVSLLLSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVIS

SEQ ID NO: 87530 - protein, 976 aa, Homo sapiens
  Payload ID: 17514
  Gene Symbol: TEK
  Gene Name: TEK tyrosine kinase, endothelial
  Uniprot ID: Q02763
  ENSP ID: ENSP00000430686
MDSLASLVLCGVSLLLSASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 87531 - protein, 468 aa, Homo sapiens
  Payload ID: 17514
  Gene Symbol: TEK
  Gene Name: TEK tyrosine kinase, endothelial
  ENSP ID: ENSP00000480251
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVSMEKQRLTKANSDK

SEQ ID NO: 87532 - protein, 418 aa, Homo sapiens
  Payload ID: 17515
  Gene Symbol: TEKT1
  Gene Name: tektin 1
  Uniprot ID: Q969V4
  ENSP ID: ENSP00000341346
MAKLLQPPPKFLPSEWHIANKNQYHRADAQRSRSERLVAESQRLVDEIEKTTRKSQSDVNKKLEQRLEEVQFWKKELDDKLEQLVNVTDDLLIYKIRLEKALETLKEPLHITETCLAYREKRIGIDLVHDTVEHELIKEAEIIQGIMALLTRTLEEASEQIRMNRSAKYNLEKDLKDKFVALTIDDICFSLNNNSPNIRYSENAVRIEPNSVSLEDWLDFSSTNVEKADKQRNNSLMLKALVDRILSQTANDLRKQCDVVDTAFKNGLKDTKDARDKLADHLAKVMEEIASQEKNITALEKAILDQEGPAKVAHTRLETRTHRPNVELCRDVAQYRLMKEVQEITHNVARLKETLAQAQAELKGLHRRQLALQEEIQVKENTIYIDEVLCMQMRKSIPLRDGEDHGVWAGGLRPDAVC

SEQ ID NO: 87533 - protein, 144 aa, Homo sapiens
  Payload ID: 17515
  Gene Symbol: TEKT1
  Gene Name: tektin 1
  ENSP ID: ENSP00000458518
  MOD_RES (1)..(1): Any amino acid
XRIEPNSVSLEDWLDFSSTNVEKADKQRNNSLMLKALVDRILSQTANDLRKQCDVVDTAFKNGLKDTKDARDKLADHLAKIEGNFSPSSGRAERAASQTACPAGGDPGQREHHLYRRSAVYADEEIHPTSGWGRPWGLGWGPPP

SEQ ID NO: 87534 - protein, 64 aa, Homo sapiens
  Payload ID: 17515
  Gene Symbol: TEKT1
  Gene Name: tektin 1
  ENSP ID: ENSP00000460197
TNVEKADKQRNNSLMLKALVDRILSQTANDLRKQCDVVDTAFKNGLKDTKDARDKLADHLAKRS

SEQ ID NO: 87535 - protein, 80 aa, Homo sapiens
  Payload ID: 17515
  Gene Symbol: TEKT1
  Gene Name: tektin 1
  ENSP ID: ENSP00000460359
MAKLLQPPPKFLPSEWHIANKNQYHRADAQRSRSERLVAESQRLVDEIEKTTRKSQSDVNKKLGRSALALTWCTTQWSMS

SEQ ID NO: 87536 - protein, 430 aa, Homo sapiens
  Payload ID: 17516
  Gene Symbol: TEKT2
  Gene Name: tektin 2 (testicular)
  Uniprot ID: Q9UIF3
  ENSP ID: ENSP00000207457
MATLSVKPSRRFQLPDWHTNSYLLSTNAQLQRDASHQIRQEARVLRNETNNQTIWDEHDNRTRLVERIDTVNRWKEMLDKCLTDLDAEIDALTQMKESAEQNLQAKNLPLDVAIECLTLRESRRDIDVVKDPVEDELHKEVEVIEATKKALQQKVSQAFEQLCLLQEVQQQLNSDHRGKMETLEIDRGCLSLNLRSPNISLKVDPTRVPDGSTTLQQWDDFSRFNKDRAEAEMKAATELREATALTIAETNNELEAQRVATEFAFRKRLREMEKVYSELKWQEKNTLEEIAELQEDIRHLEEDLRTKLLSLKLSHTRLEARTYRPNVELCRDQAQYGLTDEVHQLEATIAALKQKLAQAQDALDALCKHLARLQADIACKANSMLLDTKCMDTRRKLTVPAERFVPEVDTFTRTTNSTLSPLKSCQLELA

SEQ ID NO: 87537 - protein, 96 aa, Homo sapiens
  Payload ID: 17516
  Gene Symbol: TEKT2
  Gene Name: tektin 2 (testicular)
  ENSP ID: ENSP00000432793
  MOD_RES (1)..(1): Any amino acid
XRKRLREMEKVYSELKWQEKNTLEEIAELQEDIRHLEEDLRTKLLSLKLSHTRLEARTYRPNVELCRDQAQYGLTDEVHQLEATIAALKQKLAQAQ

SEQ ID NO: 87538 - protein, 108 aa, Homo sapiens
  Payload ID: 17516
  Gene Symbol: TEKT2
  Gene Name: tektin 2 (testicular)
  ENSP ID: ENSP00000434183
MATLSVKPSRRFQLPDWHTNSYLLSTNAQLQRDASHQIRQEARVLRNETNNQTIWDEHDNRTRLVERIDTVNRWKEMLDKCLTDLDAEIDALTQRRGFTILARLFSNS

SEQ ID NO: 87539 - protein, 490 aa, Homo sapiens
  Payload ID: 17517
  Gene Symbol: TEKT3
  Gene Name: tektin 3
  Uniprot ID: Q9BXF9
  ENSP ID: ENSP00000343995
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLGERVNDIGFWKSEIIHELDEMIGETNALTDVKKRLERALMETEAPLQVARECLFHREKRMGIDLVHDEVEAQLLTEVDTILCCQERMKLHLDKAIAQLAANRASQHELEKDLSDKQTAYRIDDKCHHLRNTSDGVGYFRGVERVDATVSVPESWAKFTDDNILRSQSERAASAKLRDDIENLLVVTANEMWNQFNKVNLSFTNRIAETADAKNKIQTHLAKTLQEIFQTEMTIESIKKAIKDKTAFLKVAQTRLDERTRRPNIELCRDMAQLRLVNEVHEVDDTIQTLQQRLRDAEDTLQSLVHIKATLEYDLAVKANSLYIDQEKCMSMRKSYPNTLRLVGFC

SEQ ID NO: 87540 - protein, 490 aa, Homo sapiens; identical to SEQ ID NO: 87539
  Payload ID: 17517
  Gene Symbol: TEKT3
  Gene Name: tektin 3
  Uniprot ID: Q9BXF9
  ENSP ID: ENSP00000379263

SEQ ID NO: 87541 - protein, 225 aa, Homo sapiens
  Payload ID: 17517
  Gene Symbol: TEKT3
  Gene Name: tektin 3
  ENSP ID: ENSP00000379264
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLGERVNDIGFWKSEIIHELDEMIGETNALTDVKKRLERALMETEAPLQVARECLFHREKRMGIDLVHDEVEAQLLTDIVT

SEQ ID NO: 87542 - protein, 140 aa, Homo sapiens
  Payload ID: 17517
  Gene Symbol: TEKT3
  Gene Name: tektin 3
  ENSP ID: ENSP00000439713
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQA

SEQ ID NO: 87543 - protein, 193 aa, Homo sapiens
  Payload ID: 17517
  Gene Symbol: TEKT3
  Gene Name: tektin 3
  ENSP ID: ENSP00000443280
MIGETNALTDVKKRLERALMETEAPLQVARECLFHREKRMGIDLVHDEVEAQLLTEVDTILCCQERMKLHLDKAIAQLAANRASQHELEKDLSDKQTAYRIDDKCHHLRNTSDGVGYFRGVERVDATVSVPESWAKFTDDNILRSQSERAASAKLRDDIENLLVVTANEMWNQFNKVNLSFTNRIAETADAKN

SEQ ID NO: 87544 - protein, 82 aa, Homo sapiens
  Payload ID: 17517
  Gene Symbol: TEKT3
  Gene Name: tektin 3
  ENSP ID: ENSP00000444180
MERVGCTLTTTYAHPRPTPTNFLPAISTMASSYRDRFPHSNLTHSLSLPWRPSTYYKVASNSPSVAPYCTRSQRVSENTMLP

SEQ ID NO: 87545 - protein, 147 aa, Homo sapiens
  Payload ID: 17517
  Gene Symbol: TEKT3
  Gene Name: tektin 3
  ENSP ID: ENSP00000446111
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLG

SEQ ID NO: 87546 - protein, 435 aa, Homo sapiens
  Payload ID: 17518
  Gene Symbol: TEKT4
  Gene Name: tektin 4
  Uniprot ID: Q8WW24
  ENSP ID: ENSP00000295201
MAQTVPPCELPCKEYDVARNTGAYTSSGLATASFRTSKYLLEEWFQNCYARYHQAFADRDQSERQRHESQQLATETQALAQRTQQDSTRTVGERLQDTHSWKSELQREMEALAAETNLLLAQKQRLERALDATEVPFSITTDNLQCRERREHPNLVRDHVETELLKEAELIRNIQELLKRTIMQAVSQIRLNREHKETCEMDWSDKMEAYNIDETCGRHHSQSTEVQAHPYSTTFQESASTPETRAKFTQDNLCRAQRERLASANLRVLVDCILRDTSEDLRLQCDAVNLAFGRRCEELEDARYKLHHHLHKTLREITDQEHNVAALKQAIKDKEAPLHVAQTRLYLRSHRPNMELCRDAAQFRLLSEVEELNMSLTALREKLLEAEQSLRNLEDIHMSLEKDIAAMTNSLFIDRQKCMAHRTRYPTILQLAGYQ

SEQ ID NO: 87547 - protein, 485 aa, Homo sapiens
  Payload ID: 17519
  Gene Symbol: TEKT5
  Gene Name: tektin 5
  Uniprot ID: Q96M29
  ENSP ID: ENSP00000283025
MEFLGTTQTASYCGPKKCCGLTSLPAVQAPVIQECYQPYYLPGYRYLNSWRPSLFYKIANVQTCPDESTSTLRPPTILPTLRSALFSRYSPHDWDQSNQLQVRGAEASRLWASRLTDDSMRLLQDKDQLTHQMQEGTCRNLGQRLSDIGFWKSELSYELDRLLTENQNLETVKRRLECAANEVNCPLQVALECLYHREKRIGIDLVHDNVEKNLIREVDLLKCCQEQMRKLAQRIDIQMRDNRDAQHVLERDLEDKSSAQCIDEKCFNLRNTSDCISFFHGMEKIDGTISVPETWAKFSNDNIKHSQNMRANSIQLREEAEHLFETLSDQMWRQFTDTNLAFNARISEVTDVKNKLQTQLAKTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 87548 - protein, 186 aa, Homo sapiens
  Payload ID: 17519
  Gene Symbol: TEKT5
  Gene Name: tektin 5
  ENSP ID: ENSP00000458802
MRKLAQRIDIQMRDNRDAQHVLERDLEDKSSAQCIDEKCFNLRNTSDCISFFHGMEKIDGTISVPETWAKFSNDNIKHSQNMRANSIQLREEAEHLFETLSDQMWRQFTDTNLAFNARISEVTDVKNKLQTQLAKTLQEIFQAENTIMLLERSIMAKEGPLKVAQTRLECRTRRPNMELCRDIPQL

SEQ ID NO: 87549 - protein, 1089 aa, Homo sapiens
  Payload ID: 17520
  Gene Symbol: TTI1
  Gene Name: TELO2 interacting protein 1
  Uniprot ID: O43156
  ENSP ID: ENSP00000362546
MAVFDTPEEAFGVLRPVCVQLTKTQTVENVEHLQTRLQAVSDSALQELQQYILFPLRFTLKTPGPKRERLIQSVVECLTFVLSSTCVKEQELLQELFSELSACLYSPSSQKPAAVSEELKLAVIQGLSTLMHSAYGDIILTFYEPSILPRLGFAVSLLLGLAEQEKSKQIKIAALKCLQVLLLQCDCQDHPRSLDELEQKQLGDLFASFLPGISTALTRLITGDFKQGHSIVVSSLKIFYKTVSFIMADEQLKRISKVQAKPAVEHRVAELMVYREADWVKKTGDKLTILIKKIIECVSVHPHWKVRLELVELVEDLLLKCSQSLVECAGPLLKALVGLVNDESPEIQAQCNKVLRHFADQKVVVGNKALADILSESLHSLATSLPRLMNSQDDQGKFSTLSLLLGYLKLLGPKINFVLNSVAHLQRLSKALIQVLELDVADIKIVEERRWNSDDLNASPKTSATQPWNRIQRRYFRFFTDERIFMLLRQVCQLLGYYGNLYLLVDHFMELYHQSVVYRKQAAMILNELVTGAAGLEVEDLHEKHIKTNPEELREIVTSILEEYTSQENWYLVTCLETEEMGEELMMEHPGLQAITSGEHTCQVTSFLAFSKPSPTICSMNSNIWQICIQLEGIGQFAYALGKDFCLLLMSALYPVLEKAGDQTLLISQVATSTMMDVCRACGYDSLQHLINQNSDYLVNGISLNLRHLALHPHTPKVLEVMLRNSDANLLPLVADVVQDVLATLDQFYDKRAASFVSVLHALMAALAQWFPDTGNLGHLQEQSLGEEGSHLNQRPAALEKSTTTAEDIEQFLLNYLKEKDVADGNVSDFDNEEEEQSVPPKVDENDTRPDVEPPLPLQIQIAMDVMERCIHLLSDKNLQIRLKVLDVLDLCVVVLQSHKNQLLPLAHQAWPSLVHRLTRDAPLAVLRAFKVLRTLGSKCGDFLRSRFCKDVLPKLAGSLVTQAPISARAGPVYSHTLAFKLQLAVLQGLGPLCERLDLGEGDLNKVADACLIYLSVKQPVKLQEAARSVFLHLMKVDPDSTWFLLNELYCPVQFTPPHPSLHPVQLHGASGQQNPYTTNVLQLLKELQ

SEQ ID NO: 87550 - protein, 1089 aa, Homo sapiens; identical to SEQ ID NO: 87549
  Payload ID: 17520
  Gene Symbol: TTI1
  Gene Name: TELO2 interacting protein 1
  Uniprot ID: O43156
  ENSP ID: ENSP00000362547

SEQ ID NO: 87551 - protein, 1089 aa, Homo sapiens; identical to SEQ ID NO: 87549
  Payload ID: 17520
  Gene Symbol: TTI1
  Gene Name: TELO2 interacting protein 1
  Uniprot ID: O43156
  ENSP ID: ENSP00000407270

SEQ ID NO: 87552 - protein, 32 aa, Homo sapiens
  Payload ID: 17520
  Gene Symbol: TTI1
  Gene Name: TELO2 interacting protein 1
  ENSP ID: ENSP00000477545
  MOD_RES (1)..(1): Any amino acid
XQFLLNYLKEKDVADGNVSDFDNEEGNLFILA

SEQ ID NO: 87553 - protein, 508 aa, Homo sapiens
  Payload ID: 17521
  Gene Symbol: TTI2
  Gene Name: TELO2 interacting protein 2
  Uniprot ID: Q6NXR4
  ENSP ID: ENSP00000353971
MELDSALEAPSQEDSNLSEELSHSAFGQAFSKILHCLARPEARRGNVKDAVLKDLGDLIEATEFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVPAADLLQYNRAQVLYHAISNHLYTPEHHLIQAVLLCLLDLFPILEKTLHWKGDGARPTTHCDEVLRLILTHMEPEHRLLLRRTYARNLPAFVNRLGILTVRHLKRLERVIIGYLEVYDGPEEEARLKILETLKLLMQHTWPRVSCRLVVLLKALLKLICDVARDPNLTPESVKSALLQEATDCLILLDRCSQGRVKGLLAKIPQSCEDRKVVNYIRKVQQVSEGAPYNGT

SEQ ID NO: 87554 - protein, 508 aa, Homo sapiens; identical to SEQ ID NO: 87553
  Payload ID: 17521
  Gene Symbol: TTI2
  Gene Name: TELO2 interacting protein 2
  Uniprot ID: Q6NXR4
  ENSP ID: ENSP00000411169

SEQ ID NO: 87555 - protein, 477 aa, Homo sapiens
  Payload ID: 17521
  Gene Symbol: TTI2
  Gene Name: TELO2 interacting protein 2
  ENSP ID: ENSP00000428401
MELDSALEAPSQEDSNLSEELSHSAFGQAFSKILHCLARPEARRGNVKDAVLKDLGDLIEATEFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVAVLLCLLDLFPILEKTLHWKGDGARPTTHCDEVLRLILTHMEPEHRLLLRRTYARNLPAFVNRLGILTVRHLKRLERVIIGYLEVYDGPEEEARLKILETLKLLMQHTWPRVSCRLVVLLKALLKLICDVARDPNLTPESVKSALLQEATDCLILLDRCSQGRVKGLLAKIPQSCEDRKVVNYIRKVQQVSEGAPYNGT

SEQ ID NO: 87556 - protein, 101 aa, Homo sapiens
  Payload ID: 17521
  Gene Symbol: TTI2
  Gene Name: TELO2 interacting protein 2
  ENSP ID: ENSP00000428569
MELDSALEAPSQEDSNLSEELSHSAFGQAFSKILHCLARPEARRGNVKDAVLKDLGDLIEATEFDRLFEGTGARLRGMPETLGQVAKALEKYAAPSKEEEG

SEQ ID NO: 87557 - protein, 508 aa, Homo sapiens; identical to SEQ ID NO: 87553
  Payload ID: 17521
  Gene Symbol: TTI2
  Gene Name: TELO2 interacting protein 2
  Uniprot ID: Q6NXR4
  ENSP ID: ENSP00000478396

SEQ ID NO: 87558 - protein, 1132 aa, Homo sapiens
  Payload ID: 17522
  Gene Symbol: TERT
  Gene Name: telomerase reverse transcriptase
  Uniprot ID: O14746
  ENSP ID: ENSP00000309572
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 87559 - protein, 1069 aa, Homo sapiens
  Payload ID: 17522
  Gene Symbol: TERT
  Gene Name: telomerase reverse transcriptase
  Uniprot ID: O14746
  ENSP ID: ENSP00000334346
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 87560 - protein, 795 aa, Homo sapiens
  Payload ID: 17522
  Gene Symbol: TERT
  Gene Name: telomerase reverse transcriptase
  Uniprot ID: O14746
  ENSP ID: ENSP00000425003
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKDRLTEVIASIIKPQNTYCVRRYAVVQKAAHGHVRKAFKSHVLRPVPGDPAGLHPLHAALQPVLRRHGEQAVCGDSAGRAAPAFGG

SEQ ID NO: 87561 - protein, 807 aa, Homo sapiens
  Payload ID: 17522
  Gene Symbol: TERT
  Gene Name: telomerase reverse transcriptase
  Uniprot ID: O14746
  ENSP ID: ENSP00000426042
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVLRPVPGDPAGLHPLHAALQPVLRRHGEQAVCGDSAGRAAPAFGG

SEQ ID NO: 87562 - protein, 2627 aa, Homo sapiens
  Payload ID: 17523
  Gene Symbol: TEP1
  Gene Name: telomerase-associated protein 1
  Uniprot ID: Q99973
  ENSP ID: ENSP00000262715
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLSSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKASLYARQQLNVRNVANNILAIAAFLPACRPHLRRYFCAIVQLPSDWIQVAELYQSLAEGDKNKLVPLPACLRTAMTDKFAQFDEYQLAKYNPRKHRAKRHPRRPPRSPGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHAKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAARRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQRLMLPHGRLSLVTGQSGQGKTAFLASLVSALQAPDGAKVASLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 87563 - protein, 250 aa, Homo sapiens
  Payload ID: 17523
  Gene Symbol: TEP1
  Gene Name: telomerase-associated protein 1
  ENSP ID: ENSP00000450475
WAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESALMGSYGTWPNAAQKENGPQVTCGRKKQTLQKPKLQGQTHLPAGNLMPAWIVMPAWIVSQHHI

SEQ ID NO: 87564 - protein, 201 aa, Homo sapiens
  Payload ID: 17523
  Gene Symbol: TEP1
  Gene Name: telomerase-associated protein 1
  ENSP ID: ENSP00000450508
  MOD_RES (1)..(1): Any amino acid
XAVSGNQAGELILWQEAKAVATAQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPH

SEQ ID NO: 87565 - protein, 1904 aa, Homo sapiens
  Payload ID: 17523
  Gene Symbol: TEP1
  Gene Name: telomerase-associated protein 1
  ENSP ID: ENSP00000450541
MLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAARRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQRLMLPHGRLSLVTGQSGQGKTAFLASLVSALQAPDGAKVASLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKPSMCYLSCW

SEQ ID NO: 87566 - protein, 70 aa, Homo sapiens
  Payload ID: 17523
  Gene Symbol: TEP1
  Gene Name: telomerase-associated protein 1
  ENSP ID: ENSP00000450830
  MOD_RES (1)..(1): Any amino acid
XPQALTALEVTRSGLTVDQLHGVLSVWRTLPKGTKSWEEAVAAGNSGDPYPMGPFACLVQSLRSSALEDM

SEQ ID NO: 87567 - protein, 102 aa, Homo sapiens
  Payload ID: 17523
  Gene Symbol: TEP1
  Gene Name: telomerase-associated protein 1
  ENSP ID: ENSP00000451409
RTLAFNVPGGVVAVGRLDSMVELWAWREGARLAAFPAHHGFVAAALFLHAGCQLLTAGEDGKMVIGWLLDIERMALGSTKSLQVPRGLRVRHWMWQCPPWPG

SEQ ID NO: 87568 - protein, 1481 aa, Homo sapiens
  Payload ID: 17523
  Gene Symbol: TEP1
  Gene Name: telomerase-associated protein 1
  ENSP ID: ENSP00000451634
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLSSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKASLYARQQLNVRNVANNILAIAAFLPACRPHLRRYFCAIVQLPSDWIQVAELYQSLAEGDKNKLVPLPACLRTAMTDKFAQFDEYQLAKYNPRKHRAKRHPRRPPRSPGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHAKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAARRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQRLMLPHGRLSLVTGQSGQGKTAFLASLVSALQAPDGAKVASLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSSALEDM

SEQ ID NO: 87569 - protein, 78 aa, Homo sapiens
  Payload ID: 17523
  Gene Symbol: TEP1
  Gene Name: telomerase-associated protein 1
  ENSP ID: ENSP00000451919
  MOD_RES (1)..(1): Any amino acid
XRLERMARFRCGQGLWVGPVGTWVPFLSLLPSLWHSAQMVIGWLLDIERMALGSTKSLQVPRGLRVRHWMWQCPPWPG

SEQ ID NO: 87570 - protein, 166 aa, Homo sapiens
  Payload ID: 17523
  Gene Symbol: TEP1
  Gene Name: telomerase-associated protein 1
  ENSP ID: ENSP00000452240
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLSSLKSTVSASPLFQSLQISHMTQADLYRVNNSNCLLSEPPSWRAQHFSKGL

SEQ ID NO: 87571 - protein, 2519 aa, Homo sapiens
  Payload ID: 17523
  Gene Symbol: TEP1
  Gene Name: telomerase-associated protein 1
  ENSP ID: ENSP00000452574
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLSSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHAKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAARRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQRLMLPHGRLSLVTGQSGQGKTAFLASLVSALQAPDGAKVASLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 87572 - protein, 837 aa, Homo sapiens
  Payload ID: 17524
  Gene Symbol: TELO2
  Gene Name: telomere maintenance 2
  Uniprot ID: Q9Y4R8
  ENSP ID: ENSP00000262319
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTQPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 87573 - protein, 426 aa, Homo sapiens
  Payload ID: 17524
  Gene Symbol: TELO2
  Gene Name: telomere maintenance 2
  ENSP ID: ENSP00000456383
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTQPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVQIQLRGRPLLLPPPSAL

SEQ ID NO: 87574 - protein, 160 aa, Homo sapiens
  Payload ID: 17524
  Gene Symbol: TELO2
  Gene Name: telomere maintenance 2
  ENSP ID: ENSP00000457461
  MOD_RES (1)..(1): Any amino acid
XLDSDDEFVPYDMSGDRELKSSKAPAYVRDCVEALTTSEDIERWEAALRALEGLVYRSPTATREVADYLTSQFYALNYSLRQRMDILDVLTLAAQELSRPGCLGRTPQPGSPSPNTPCLPEAAVSQPGSAVASDWRVVVEERIRSKTQRLSKGGPRQGPA

SEQ ID NO: 87575 - protein, 419 aa, Homo sapiens
  Payload ID: 17525
  Gene Symbol: TERF1
  Gene Name: telomeric repeat binding factor (NIMA-interacting) 1
  Uniprot ID: P54274
  ENSP ID: ENSP00000276602
MAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 87576 - protein, 439 aa, Homo sapiens
  Payload ID: 17525
  Gene Symbol: TERF1
  Gene Name: telomeric repeat binding factor (NIMA-interacting) 1
  Uniprot ID: P54274
  ENSP ID: ENSP00000276603
MAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKSVSDKQSAVTESSEGTVSLLRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 87577 - protein, 168 aa, Homo sapiens
  Payload ID: 17525
  Gene Symbol: TERF1
  Gene Name: telomeric repeat binding factor (NIMA-interacting) 1
  ENSP ID: ENSP00000428838
MAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEDAQFENDERITPLESALMIWGSIEKEHDKLHEEIQNLIKIQAIAVCMENGNFKEAEEVFERI

SEQ ID NO: 87578 - protein, 186 aa, Homo sapiens
  Payload ID: 17525
  Gene Symbol: TERF1
  Gene Name: telomeric repeat binding factor (NIMA-interacting) 1
  ENSP ID: ENSP00000430121
MFTIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEAN

SEQ ID NO: 87579 - protein, 542 aa, Homo sapiens
  Payload ID: 17526
  Gene Symbol: TERF2
  Gene Name: telomeric repeat binding factor 2
  Uniprot ID: Q15554
  ENSP ID: ENSP00000254942
MAAGAGTAGPASGPGVVRDPAASQPRKRPGREGGEGARRSDTMAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 87580 - protein, 293 aa, Homo sapiens
  Payload ID: 17526
  Gene Symbol: TERF2
  Gene Name: telomeric repeat binding factor 2
  Uniprot ID: Q15554
  ENSP ID: ENSP00000454955
MAAGAGTAGPASGPGVVRDPAASQPRKRPGREGGEGARRSDTMAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTVRLGPSPITMVCP

SEQ ID NO: 87581 - protein, 283 aa, Homo sapiens
  Payload ID: 17526
  Gene Symbol: TERF2
  Gene Name: telomeric repeat binding factor 2
  ENSP ID: ENSP00000456022
MSSLPALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRL

SEQ ID NO: 87582 - protein, 60 aa, Homo sapiens
  Payload ID: 17526
  Gene Symbol: TERF2
  Gene Name: telomeric repeat binding factor 2
  ENSP ID: ENSP00000456062
  MOD_RES (1)..(1): Any amino acid
XAERGAGEARLEEAVNRWVLKFYFHEALRAFRGSRFACQALGEGAHRVPIAAGYAVSVAD

SEQ ID NO: 87583 - protein, 206 aa, Homo sapiens
  Payload ID: 17526
  Gene Symbol: TERF2
  Gene Name: telomeric repeat binding factor 2
  ENSP ID: ENSP00000457094
MEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTIGFMAKKALKSESAASSTGKEDKQPAPGPVEKPPREPARQLRNPPTTIGMMTLKAAFKTLSGAQDSEAAFAKLDQKDLVLPTQALPASP

SEQ ID NO: 87584 - protein, 99 aa, Homo sapiens
  Payload ID: 17526
  Gene Symbol: TERF2
  Gene Name: telomeric repeat binding factor 2
  ENSP ID: ENSP00000462523
AVIICIKNKEFEKASKILKKHMSKDPTTQKLRNDLLNIIREKNLAHPVIQNFSYETFQQKMLRFLESHLDDAEPYLLTIGFVSELVCILSIFLVKEAEN

SEQ ID NO: 87585 - protein, 144 aa, Homo sapiens
  Payload ID: 17526
  Gene Symbol: TERF2
  Gene Name: telomeric repeat binding factor 2
  ENSP ID: ENSP00000462726
  MOD_RES (1)..(1): Any amino acid
XMIKTEFTLTEAVVESSRKLVKEAMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMT

SEQ ID NO: 87586 - protein, 49 aa, Homo sapiens
  Payload ID: 17526
  Gene Symbol: TERF2
  Gene Name: telomeric repeat binding factor 2
  ENSP ID: ENSP00000463079
  MOD_RES (1)..(1): Any amino acid
XNSSNGVEEKETWVEEDELFQVQEVDCRRKRVGQGWSAEIWGRKLGCHF

SEQ ID NO: 87587 - protein, 244 aa, Homo sapiens
  Payload ID: 17526
  Gene Symbol: TERF2
  Gene Name: telomeric repeat binding factor 2
  ENSP ID: ENSP00000475507
  MOD_RES (1)..(1): Any amino acid
XPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKYEDLLCRNFGAGWWSWLGLVLLP

SEQ ID NO: 87588 - protein, 86 aa, Homo sapiens
  Payload ID: 17526
  Gene Symbol: TERF2
  Gene Name: telomeric repeat binding factor 2
  ENSP ID: ENSP00000476905
MQCLSRIEEGENLDCSFDMEAELTPLESAINVLEMIKTEFTLTEAVVESSRKLVKEAAVIICIKNKEFEKASKILKKHMSKDPTTQ

SEQ ID NO: 87589 - protein, 399 aa, Homo sapiens
  Payload ID: 17527
  Gene Symbol: TERF2IP
  Gene Name: telomeric repeat binding factor 2, interacting protein
  Uniprot ID: Q9NYB0
  ENSP ID: ENSP00000300086
MAEAMDLGKDPNGPTHSSTLFVRDDGSSMSFYVRPSPAKRRLSTLILHGGGTVCRVQEPGAVLLAQPGEALAEASGDFISTQYILDCVERNERLELEAYRLGPASAADTGSEAKPGALAEGAAEPEPQRHAGRIAFTDADDVAILTYVKENARSPSSVTGNALWKAMEKSSLTQHSWQSLKDRYLKHLRGQEHKYLLGDAPVSPSSQKLKRKAEEDPEAADSGEPQNKRTPDLPEEEYVKEEIQENEEAVKKMLVEATREFEEVVVDESPPDFEIHITMCDDDPPTPEEDSETQPDEEEEEEEEKVSQPEVGAAIKIIRQLMEKFNLDLSTVTQAFLKNSGELEATSAFLASGQRADGYPIWSRQDDIDLQKDDEDTREALVKKFGAQNVARRIEFRKK

SEQ ID NO: 87590 - protein, 99 aa, Homo sapiens
  Payload ID: 17527
  Gene Symbol: TERF2IP
  Gene Name: telomeric repeat binding factor 2, interacting protein
  ENSP ID: ENSP00000454399
LTQHSWQSLKDRYLKHLRGQEHKYLLGDAPVSPSSQKLKRKAEEDPEAADSGGEEAERGASRISARVGLGSFSWLPGVHLGIFGSSAWPRPLLTSGTTE

SEQ ID NO: 87591 - protein, 122 aa, Homo sapiens
  Payload ID: 17527
  Gene Symbol: TERF2IP
  Gene Name: telomeric repeat binding factor 2, interacting protein
  ENSP ID: ENSP00000456092
VDESPPDFEIHITMCDDDPPTPEEDSETQPDEEEEEEEEKVSQPEVSISSQSWLILSSTFGRFSCIWAGYAFSTSGSHSHHPECSAVARSQLSAASISQAQAILPPQPPEKLELQECATASG

SEQ ID NO: 87592 - protein, 123 aa, Homo sapiens
  Payload ID: 17528
  Gene Symbol: TEN1
  Gene Name: TEN1 CST complex subunit
  Uniprot ID: Q86WV5
  ENSP ID: ENSP00000380762
MMLPKPGTYYLPWEVSAGQVPDGSTLRTFGRLCLYDMIQSRVTLMAQHGSDQHQVLVCTKLVEPFHAQVGSLYIVLGELQHQQDRGSVVKARVLTCVEGMNLPLLEQAIREQRLYKQERGGSQ

SEQ ID NO: 87593 - protein, 101 aa, Homo sapiens
  Payload ID: 17528
  Gene Symbol: TEN1
  Gene Name: TEN1 CST complex subunit
  ENSP ID: ENSP00000464792
MCLRGCKRNVLMKRVKLGKARWLMPVIPALWEAKEPMMLPKPGTYYLPWEVSAGQVPDGSTLRTFGRLCLYDMIQSRVTLMAQHGSDQHQVLVCTKLVEPF

SEQ ID NO: 87594 - protein, 55 aa, Homo sapiens
  Payload ID: 17528
  Gene Symbol: TEN1
  Gene Name: TEN1 CST complex subunit
  ENSP ID: ENSP00000465299
MMLPKPGTYYLPWEVSAGQVPDGSTLRTFGRLCLYDMIQSRVTLMAQHGSDQHQV

SEQ ID NO: 87595 - protein, 73 aa, Homo sapiens
  Payload ID: 17528
  Gene Symbol: TEN1
  Gene Name: TEN1 CST complex subunit
  ENSP ID: ENSP00000465866
MMLPKPGTYYLPWEVSAGQVPDGSTLRTFGRLCLYDMIQSRVTLMAQHGSDQHQVLVCTKLVEPFHAQTEAPW

SEQ ID NO: 87596 - protein, 305 aa, Homo sapiens; identical to SEQ ID NO: 21297
  Payload ID: 17529
  Gene Symbol: TEN1-CDK3
  Gene Name: TEN1-CDK3 readthrough (NMD candidate)
  ENSP ID: ENSP00000400088

SEQ ID NO: 87597 - protein, 2201 aa, Homo sapiens
  Payload ID: 17530
  Gene Symbol: TNC
  Gene Name: tenascin C
  Uniprot ID: P24821
  ENSP ID: ENSP00000265131
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 87598 - protein, 2019 aa, Homo sapiens
  Payload ID: 17530
  Gene Symbol: TNC
  Gene Name: tenascin C
  ENSP ID: ENSP00000339553
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 87599 - protein, 1928 aa, Homo sapiens
  Payload ID: 17530
  Gene Symbol: TNC
  Gene Name: tenascin C
  ENSP ID: ENSP00000411406
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 87600 - protein, 1838 aa, Homo sapiens
  Payload ID: 17530
  Gene Symbol: TNC
  Gene Name: tenascin C
  ENSP ID: ENSP00000438152
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAKEPEIGNLNVSDITPESFNLSWMATDGIFETFTIEIIDSNRLLETVEYNISGAERTAHISGLPPSTDFIVYLSGLAPSIRTKTISATATTEPKPQLGTLIFSNITPKSFNMSWTTQAGLFAKIVINVSDAHSLHESQQFTVSGDAKQAHITGLVENTGYDVSVAGTTLAGDPTRPLTAFVITEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 87601 - protein, 1838 aa, Homo sapiens; identical to SEQ ID NO: 87600
  Payload ID: 17530
  Gene Symbol: TNC
  Gene Name: tenascin C
  ENSP ID: ENSP00000442242

SEQ ID NO: 87602 - protein, 92 aa, Homo sapiens
  Payload ID: 17530
  Gene Symbol: TNC
  Gene Name: tenascin C
  ENSP ID: ENSP00000443469
MGAMTQLLAGVFLAFLALATEGGVLKKVIRHKRQSGVNATLPEENQPVVFNHVYNIKLPVGSQCSVDLESASGEKDLAPPSEPSESFQEHTV

SEQ ID NO: 87603 - protein, 1564 aa, Homo sapiens
  Payload ID: 17530
  Gene Symbol: TNC
  Gene Name: tenascin C
  Uniprot ID: P24821
  ENSP ID: ENSP00000443478
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 87604 - protein, 615 aa, Homo sapiens
  Payload ID: 17530
  Gene Symbol: TNC
  Gene Name: tenascin C
  ENSP ID: ENSP00000445380
  MOD_RES (1)..(1): Any amino acid
XPELENLTVTEVGWDGLRLNWTAADQAYEHFIIQVQEANKVEAARNLTVPGSLRAVDIPGLKAATPYTVSIYGVIQGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRRE

SEQ ID NO: 87605 - protein, 23 aa, Homo sapiens
  Payload ID: 17530
  Gene Symbol: TNC
  Gene Name: tenascin C
  ENSP ID: ENSP00000489385
ASTEAEPEVDNLLVSDATPDGFR

SEQ ID NO: 87606 - protein, 1299 aa, Homo sapiens
  Payload ID: 17531
  Gene Symbol: TNN
  Gene Name: tenascin N
  Uniprot ID: Q9UQP3
  ENSP ID: ENSP00000239462
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDKYVVRYTSADDQETREVLVGKEQSSTVLTGLRPGVEYTVHVWAQKGDRESKKADTNAPTDIDSPKNLVTDRVTENMATVSWDPVQAAIDKYVVRYTSAGGETREVPVGKEQSSTVLTGLRPGMEYMVHVWAQKGDQESKKADTKAQTDIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 87607 - protein, 1122 aa, Homo sapiens
  Payload ID: 17531
  Gene Symbol: TNN
  Gene Name: tenascin N
  ENSP ID: ENSP00000480895
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTDIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 87608 - protein, 1122 aa, Homo sapiens
  Payload ID: 17531
  Gene Symbol: TNN
  Gene Name: tenascin N
  ENSP ID: ENSP00000481259
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 87609 - protein, 1358 aa, Homo sapiens
  Payload ID: 17532
  Gene Symbol: TNR
  Gene Name: tenascin R
  Uniprot ID: Q92752
  ENSP ID: ENSP00000263525
MGADGETVVLKNMLIGINLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 87610 - protein, 1358 aa, Homo sapiens; identical to SEQ ID NO: 87609
  Payload ID: 17532
  Gene Symbol: TNR
  Gene Name: tenascin R
  Uniprot ID: Q92752
  ENSP ID: ENSP00000356646

SEQ ID NO: 87611 - protein, 180 aa, Homo sapiens
  Payload ID: 17532
  Gene Symbol: TNR
  Gene Name: tenascin R
  ENSP ID: ENSP00000403413
  MOD_RES (1)..(1): Any amino acid
XINFPKKACPCASSAQVLQELLSRIEMLEREVSVLRDQCNANCCQESAATVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNE

SEQ ID NO: 87612 - protein, 4244 aa, Homo sapiens
  Payload ID: 17533
  Gene Symbol: TNXB
  Gene Name: tenascin XB
  Uniprot ID: P22105
  ENSP ID: ENSP00000364393
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTAPEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87613 - protein, 4222 aa, Homo sapiens
  Payload ID: 17533
  Gene Symbol: TNXB
  Gene Name: tenascin XB
  ENSP ID: ENSP00000372645
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYAGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87614 - protein, 3296 aa, Homo sapiens
  Payload ID: 17533
  Gene Symbol: TNXB
  Gene Name: tenascin XB
  ENSP ID: ENSP00000387438
  MOD_RES (1)..(1): Any amino acid
XSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPQAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRVEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87615 - protein, 4222 aa, Homo sapiens
  Payload ID: 17533
  Gene Symbol: TNXB
  Gene Name: tenascin XB
  ENSP ID: ENSP00000387561
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPHPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTIPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQATWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87616 - protein, 7 aa, Homo sapiens
  Payload ID: 17533
  Gene Symbol: TNXB
  Gene Name: tenascin XB
  ENSP ID: ENSP00000388950
MMPAQYA

SEQ ID NO: 87617 - protein, 634 aa, Homo sapiens
  Payload ID: 17533
  Gene Symbol: TNXB
  Gene Name: tenascin XB
  ENSP ID: ENSP00000389677
  MOD_RES (1)..(1): Any amino acid
XSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVT

SEQ ID NO: 87618 - protein, 7 aa, Homo sapiens
  Payload ID: 17533
  Gene Symbol: TNXB
  Gene Name: tenascin XB
  ENSP ID: ENSP00000389946
MMPAQYA

SEQ ID NO: 87619 - protein, 2280 aa, Homo sapiens
  Payload ID: 17533
  Gene Symbol: TNXB
  Gene Name: tenascin XB
  ENSP ID: ENSP00000393091
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLT

SEQ ID NO: 87620 - protein, 4222 aa, Homo sapiens
  Payload ID: 17533
  Gene Symbol: TNXB
  Gene Name: tenascin XB
  ENSP ID: ENSP00000399153
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87621 - protein, 7 aa, Homo sapiens
  Payload ID: 17533
  Gene Symbol: TNXB
  Gene Name: tenascin XB
  ENSP ID: ENSP00000399599
MMPAQYA

SEQ ID NO: 87622 - protein, 7 aa, Homo sapiens
  Payload ID: 17533
  Gene Symbol: TNXB
  Gene Name: tenascin XB
  ENSP ID: ENSP00000404573
MMPAQYA

SEQ ID NO: 87623 - protein, 2149 aa, Homo sapiens
  Payload ID: 17533
  Gene Symbol: TNXB
  Gene Name: tenascin XB
  ENSP ID: ENSP00000406495
  MOD_RES (1)..(1): Any amino acid
XAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVTGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87624 - protein, 673 aa, Homo sapiens
  Payload ID: 17533
  Gene Symbol: TNXB
  Gene Name: tenascin XB
  Uniprot ID: P22105
  ENSP ID: ENSP00000407685
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87625 - protein, 7 aa, Homo sapiens
  Payload ID: 17533
  Gene Symbol: TNXB
  Gene Name: tenascin XB
  ENSP ID: ENSP00000412400
MMPAQYA

SEQ ID NO: 87626 - protein, 7 aa, Homo sapiens
  Payload ID: 17533
  Gene Symbol: TNXB
  Gene Name: tenascin XB
  ENSP ID: ENSP00000416813
MMPAQYA

SEQ ID NO: 87627 - protein, 842 aa, Homo sapiens
  Payload ID: 17533
  Gene Symbol: TNXB
  Gene Name: tenascin XB
  ENSP ID: ENSP00000418248
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTASPLLCSASPHSPAKAEAEISTSWRNQDSLNFFFCLNIFFCCCYKNTLITRQEFGN

SEQ ID NO: 87628 - protein, 535 aa, Homo sapiens
  Payload ID: 17533
  Gene Symbol: TNXB
  Gene Name: tenascin XB
  Uniprot ID: P22105
  ENSP ID: ENSP00000447694
MVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87629 - protein, 4242 aa, Homo sapiens
  Payload ID: 17533
  Gene Symbol: TNXB
  Gene Name: tenascin XB
  ENSP ID: ENSP00000447829
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPHPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTIPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQATWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87630 - protein, 4242 aa, Homo sapiens
  Payload ID: 17533
  Gene Symbol: TNXB
  Gene Name: tenascin XB
  ENSP ID: ENSP00000447841
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPRLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDIQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQTQEILLPGGITSHQLLGLFPSTSYNARLQAMWGQSLLPPVSTSFTTGGLRIPFPRDCGEEMQNGAGASRTSTIFLNGNRERPLIVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87631 - protein, 535 aa, Homo sapiens
  Payload ID: 17533
  Gene Symbol: TNXB
  Gene Name: tenascin XB
  Uniprot ID: P22105
  ENSP ID: ENSP00000448326
MVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87632 - protein, 4242 aa, Homo sapiens
  Payload ID: 17533
  Gene Symbol: TNXB
  Gene Name: tenascin XB
  ENSP ID: ENSP00000449211
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYAGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87633 - protein, 1545 aa, Homo sapiens
  Payload ID: 17533
  Gene Symbol: TNXB
  Gene Name: tenascin XB
  ENSP ID: ENSP00000480067
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTEEREEESPPRPSLSQPPRRPWGNLTAELSRFRGTVQDLERHLRAHGYPLRANQTYTSVARHIHEYLQRQVLGSSADGALLVSLDGLRGQFERVVLRWRPQPPAEGPGGELTVPGTTRTVSLPDLRPGTTYHVEVHGVRAGQTSKSYAFITTTGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVT

SEQ ID NO: 87634 - protein, 1962 aa, Homo sapiens
  Payload ID: 17533
  Gene Symbol: TNXB
  Gene Name: tenascin XB
  ENSP ID: ENSP00000483409
APGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 87635 - protein, 2725 aa, Homo sapiens
  Payload ID: 17534
  Gene Symbol: TENM1
  Gene Name: teneurin transmembrane protein 1
  Uniprot ID: Q9UKZ4
  ENSP ID: ENSP00000360171
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHFLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGGWSLNKHHILNPQSGIIHKGNGENMFISQQPPVISTIMGNGHQRSVACTNCNGPAHNNKLFAPVALASGPDGSVYVGDFNFVRRIFPSGNSVSILELSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNLALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQPDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSVLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 87636 - protein, 2732 aa, Homo sapiens
  Payload ID: 17534
  Gene Symbol: TENM1
  Gene Name: teneurin transmembrane protein 1
  Uniprot ID: Q9UKZ4
  ENSP ID: ENSP00000403954
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHFLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGGWSLNKHHILNPQSGIIHKGNGENMFISQQPPVISTIMGNGHQRSVACTNCNGPAHNNKLFAPVALASGPDGSVYVGDFNFVRRIFPSGNSVSILELRNRDTRHSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNLALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQPDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSVLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 87637 - protein, 2598 aa, Homo sapiens
  Payload ID: 17535
  Gene Symbol: TENM2
  Gene Name: teneurin transmembrane protein 2
  ENSP ID: ENSP00000384905
GRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 87638 - protein, 2535 aa, Homo sapiens
  Payload ID: 17535
  Gene Symbol: TENM2
  Gene Name: teneurin transmembrane protein 2
  ENSP ID: ENSP00000427874
MVSPPLLIISVAGTIECKPDHLLWRPGSTSPQSVSFLHGKVVMESLGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 87639 - protein, 2653 aa, Homo sapiens
  Payload ID: 17535
  Gene Symbol: TENM2
  Gene Name: teneurin transmembrane protein 2
  ENSP ID: ENSP00000428964
MVSPPLLIISVAGTIECKPDHLLWRPGSTSPQSVSFLHGKVVMESLGRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 87640 - protein, 2774 aa, Homo sapiens
  Payload ID: 17535
  Gene Symbol: TENM2
  Gene Name: teneurin transmembrane protein 2
  Uniprot ID: Q9NT68
  ENSP ID: ENSP00000429430
MDVKDRRHRSLTRGRCGKECRYTSSSLDSEDCRVPTQKSYSSSETLKAYDHDSRMHYGNRVTDLIHRESDEFPRQGTNFTLAELGICEPSPHRSGYCSDMGILHQGYSLSTGSDADSDTEGGMSPEHAIRLWGRGIKSRRSSGLSSRENSALTLTDSDNENKSDDENGRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 87641 - protein, 2607 aa, Homo sapiens
  Payload ID: 17535
  Gene Symbol: TENM2
  Gene Name: teneurin transmembrane protein 2
  ENSP ID: ENSP00000438635
GRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIARQTGGRETNGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 87642 - protein, 2529 aa, Homo sapiens
  Payload ID: 17536
  Gene Symbol: TENM3
  Gene Name: teneurin transmembrane protein 3
  ENSP ID: ENSP00000385276
EQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 87643 - protein, 170 aa, Homo sapiens
  Payload ID: 17536
  Gene Symbol: TENM3
  Gene Name: teneurin transmembrane protein 3
  ENSP ID: ENSP00000421320
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSEN

SEQ ID NO: 87644 - protein, 2699 aa, Homo sapiens
  Payload ID: 17536
  Gene Symbol: TENM3
  Gene Name: teneurin transmembrane protein 3
  Uniprot ID: Q9P273
  ENSP ID: ENSP00000424226
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 87645 - protein, 182 aa, Homo sapiens
  Payload ID: 17536
  Gene Symbol: TENM3
  Gene Name: teneurin transmembrane protein 3
  ENSP ID: ENSP00000426914
VTRYAPDPGNLAALGSVPHGHSEGAPRQEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAIL

SEQ ID NO: 87646 - protein, 2769 aa, Homo sapiens
  Payload ID: 17537
  Gene Symbol: TENM4
  Gene Name: teneurin transmembrane protein 4
  Uniprot ID: Q6N022
  ENSP ID: ENSP00000278550
MDVKERKPYRSLTRRRDAERRYTSSSADSEEGKAPQKSYSSSETLKAYDQDARLAYGSRVKDIVPQEAEEFCRTGANFTLRELGLEEVTPPHGTLYRTDIGLPHCGYSMGAGSDADMEADTVLSPEHPVRLWGRSTRSGRSSCLSSRANSNLTLTDTEHENTETDHPGGLQNHARLRTPPPPLSHAHTPNQHHAASINSLNRGNFTPRSNPSPAPTDHSLSGEPPAGGAQEPAHAQENWLLNSNIPLETRNLGKQPFLGTLQDNLIEMDILGASRHDGAYSDGHFLFKPGGTSPLFCTTSPGYPLTSSTVYSPPPRPLPRSTFARPAFNLKKPSKYCNWKCAALSAIVISATLVILLAYFVAMHLFGLNWHLQPMEGQMYEITEDTASSWPVPTDVSLYPSGGTGLETPDRKGKGTTEGKPSSFFPEDSFIDSGEIDVGRRASQKIPPGTFWRSQVFIDHPVHLKFNVSLGKAALVGIYGRKGLPPSHTQFDFVELLDGRRLLTQEARSLEGTPRQSRGTVPPSSHETGFIQYLDSGIWHLAFYNDGKESEVVSFLTTAIESVDNCPSNCYGNGDCISGTCHCFLGFLGPDCGRASCPVLCSGNGQYMKGRCLCHSGWKGAECDVPTNQCIDVACSNHGTCITGTCICNPGYKGESCEEVDCMDPTCSGRGVCVRGECHCSVGWGGTNCETPRATCLDQCSGHGTFLPDTGLCSCDPSWTGHDCSIEICAADCGGHGVCVGGTCRCEDGWMGAACDQRACHPRCAEHGTCRDGKCECSPGWNGEHCTIAHYLDRVVKEGCPGLCNGNGRCTLDLNGWHCVCQLGWRGAGCDTSMETACGDSKDNDGDGLVDCMDPDCCLQPLCHINPLCLGSPNPLDIIQETQVPVSQQNLHSFYDRIKFLVGRDSTHIIPGENPFDGGHACVIRGQVMTSDGTPLVGVNISFVNNPLFGYTISRQDGSFDLVTNGGISIILRFERAPFITQEHTLWLPWDRFFVMETIIMRHEENEIPSCDLSNFARPNPVVSPSPLTSFASSCAEKGPIVPEIQALQEEISISGCKMRLSYLSSRTPGYKSVLRISLTHPTIPFNLMKVHLMVAVEGRLFRKWFAAAPDLSYYFIWDKTDVYNQKVFGLSEAFVSVGYEYESCPDLILWEKRTTVLQGYEIDASKLGGWSLDKHHALNIQSGILHKGNGENQFVSQQPPVIGSIMGNGRRRSISCPSCNGLADGNKLLAPVALTCGSDGSLYVGDFNYIRRIFPSGNVTNILELRNKDFRHSHSPAHKYYLATDPMSGAVFLSDSNSRRVFKIKSTVVVKDLVKNSEVVAGTGDQCLPFDDTRCGDGGKATEATLTNPRGITVDKFGLIYFVDGTMIRRIDQNGIISTLLGSNDLTSARPLSCDSVMDISQVHLEWPTDLAINPMDNSLYVLDNNVVLQISENHQVRIVAGRPMHCQVPGIDHFLLSKVAIHATLESATALAVSHNGVLYIAETDEKKINRIRQVTTSGEISLVAGAPSGCDCKNDANCDCFSGDDGYAKDAKLNTPSSLAVCADGELYVADLGNIRIRFIRKNKPFLNTQNMYELSSPIDQELYLFDTTGKHLYTQSLPTGDYLYNFTYTGDGDITLITDNNGNMVNVRRDSTGMPLWLVVPDGQVYWVTMGTNSALKSVTTQGHELAMMTYHGNSGLLATKSNENGWTTFYEYDSFGRLTNVTFPTGQVSSFRSDTDSSVHVQVETSSKDDVTITTNLSASGAFYTLLQDQVRNSYYIGADGSLRLLLANGMEVALQTEPHLLAGTVNPTVGKRNVTLPIDNGLNLVEWRQRKEQARGQVTVFGRRLRVHNRNLLSLDFDRVTRTEKIYDDHRKFTLRILYDQAGRPSLWSPSSRLNGVNVTYSPGGYIAGIQRGIMSERMEYDQAGRITSRIFADGKTWSYTYLEKSMVLLLHSQRQYIFEFDKNDRLSSVTMPNVARQTLETIRSVGYYRNIYQPPEGNASVIQDFTEDGHLLHTFYLGTGRRVIYKYGKLSKLAETLYDTTKVSFTYDETAGMLKTINLQNEGFTCTIRYRQIGPLIDRQIFRFTEEGMVNARFDYNYDNSFRVTSMQAVINETPLPIDLYRYDDVSGKTEQFGKFGVIYYDINQIITTAVMTHTKHFDAYGRMKEVQYEIFRSLMYWMTVQYDNMGRVVKKELKVGPYANTTRYSYEYDADGQLQTVSINDKPLWRYSYDLNGNLHLLSPGNSARLTPLRYDIRDRITRLGDVQYKMDEDGFLRQRGGDIFEYNSAGLLIKAYNRAGSWSVRYRYDGLGRRVSSKSSHSHHLQFFYADLTNPTKVTHLYNHSSSEITSLYYDLQGHLFAMELSSGDEFYIACDNIGTPLAVFSGTGLMIKQILYTAYGEIYMDTNPNFQIIIGYHGGLYDPLTKLVHMGRRDYDVLAGRWTSPDHELWKHLSSSNVMPFNLYMFKNNNPISNSQDIKCFMTDVNSWLLTFGFQLHNVIPGYPKPDMDAMEPSYELIHTQMKTQEWDNSKSILGVQCEVQKQLKAFVTLERFDQLYGSTITSCQQAPKTKKFASSGSVFGKGVKFALKDGRVTTDIISVANEDGRRVAAILNHAHYLENLHFTIDGVDTHYFVKPGPSEGDLAILGLSGGRRTLENGVNVTVSQINTVLNGRTRRYTDIQLQYGALCLNTRYGTTLDEEKARVLELARQRAVRQAWAREQQRLREGEEGLRAWTEGEKQQVLSTGRVQGYDGFFVISVEQYPELSDSANNIHFMRQSEMGRR

SEQ ID NO: 87647 - protein, 951 aa, Homo sapiens
  Payload ID: 17537
  Gene Symbol: TENM4
  Gene Name: teneurin transmembrane protein 4
  ENSP ID: ENSP00000431711
NTPSSLAVCADGELYVADLGNIRIRFIRKNKPFLNTQNMYELSSPIDQELYLFDTTGKHLYTQSLPTGDYLYNFTYTGDGDITLITDNNGNMVNVRRDSTGMPLWLVVPDGQVYWVTMGTNSALKSVTTQGHELAMMTYHGNSGLLATKSNENGWTTFYEYDSFGRLTNVTFPTGQVSSFRSDTDSSVHVQVETSSKDDVTITTNLSASGAFYTLLQDQVRNSYYIGADGSLRLLLANGMEVALQTEPHLLAGTVNPTVGKRNVTLPIDNGLNLVEWRQRKEQARGQVTVFGRRLRVHNRNLLSLDFDRVTRTEKIYDDHRKFTLRILYDQAGRPSLWSPSSRLNGVNVTYSPGGYIAGIQRGIMSERMEYDQAGRITSRIFADGKTWSYTYLEKSMVLLLHSQRQYIFEFDKNDRLSSVTMPNVARQTLETIRSVGYYRNIYQPPEGNASVIQDFTEDGHLLHTFYLGTGRRVIYKYGKLSKLAETLYDTTKVSFTYDETAGMLKTINLQNEGFTCTIRYRQIGPLIDRQIFRFTEEGMVNARFDYNYDNSFRVTSMQAVINETPLPIDLYRYDDVSGKTEQFGKFGVIYYDINQIITTAVMTHTKHFDAYGRMKEVQYEIFRSLMYWMTVQYDNMGRVVKKELKVGPYANTTRYSYEYDADGQLQTVSINDKPLWRYSYDLNGNLHLLSPGNSARLTPLRYDIRDRITRLGDVQYKMDEDGFLRQRGGDIFEYNSAGLLIKAYNRAGSWSVRYRYDGLGRRVSSKSSHSHHLQFFYADLTNPTKVTHLYNHSSSEITSLYYDLQGHLFAMELSSGDEFYIACDNIGTPLAVFSGTGLMIKQILYTAYGEIYMDTNPNFQIIIGYHGGLYDPLTKLVHMGRRDYDVLAGRWTSPDHELWKHLSSSNVMPFNLYMFKNNNPISNSQDIKCFMTERTKDFLPKTATLLWPHT

SEQ ID NO: 87648 - protein, 151 aa, Homo sapiens
  Payload ID: 17537
  Gene Symbol: TENM4
  Gene Name: teneurin transmembrane protein 4
  ENSP ID: ENSP00000432427
  MOD_RES (1)..(1): Any amino acid
XNCETPRATCLDQCSGHGTFLPDTGLCSCDPSWTGHDCSIEICAADCGGHGVCVGGTCRCEDGWMGAACDQRACHPRCAEHGTCRDGKCECSPGWNGEHCTIEGCPGLCNGNGRCTLDLNGWHCVCQLGWRGAGCDTSMETACGDSKDNDG

SEQ ID NO: 87649 - protein, 157 aa, Homo sapiens
  Payload ID: 17537
  Gene Symbol: TENM4
  Gene Name: teneurin transmembrane protein 4
  ENSP ID: ENSP00000432705
MKQCEVAEMDHPGGLQNHARLRTPPPPLSHAHTPNQHHAASINSLNRGNFTPRSNPSPAPTDHSLSGEPPAGGAQEPAHAQENWLLNSNIPLETRNLGKQPFLGTLQDNLIEMDILGASRHDGAYSDGHFLFKPGGTSPLFCTTSPGYPLTSSTVYS

SEQ ID NO: 87650 - protein, 1 aa, Homo sapiens
  Payload ID: 17537
  Gene Symbol: TENM4
  Gene Name: teneurin transmembrane protein 4
  ENSP ID: ENSP00000433535
M

SEQ ID NO: 87651 - protein, 2769 aa, Homo sapiens; identical to SEQ ID NO: 87646
  Payload ID: 17537
  Gene Symbol: TENM4
  Gene Name: teneurin transmembrane protein 4
  Uniprot ID: Q6N022
  ENSP ID: ENSP00000483150

SEQ ID NO: 87652 - protein, 317 aa, Homo sapiens
  Payload ID: 17538
  Gene Symbol: TNMD
  Gene Name: tenomodulin
  Uniprot ID: Q9H2S6
  ENSP ID: ENSP00000362122
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 87653 - protein, 1735 aa, Homo sapiens
  Payload ID: 17539
  Gene Symbol: TNS1
  Gene Name: tensin 1
  Uniprot ID: Q9HBL0
  ENSP ID: ENSP00000171887
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEEDEGKVVVRLSEEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 87654 - protein, 416 aa, Homo sapiens
  Payload ID: 17539
  Gene Symbol: TNS1
  Gene Name: tensin 1
  Uniprot ID: Q9HBL0
  ENSP ID: ENSP00000308321
MVPFQQRKDCVLEGSTRVTPSVQPHLQPIRNMSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEDGNKQNTNSQSIGSISGGLEDQYTWPDTHWPSQS

SEQ ID NO: 87655 - protein, 24 aa, Homo sapiens
  Payload ID: 17539
  Gene Symbol: TNS1
  Gene Name: tensin 1
  ENSP ID: ENSP00000393925
MSVSRTMEDSCELDLVYVTERIIA

SEQ ID NO: 87656 - protein, 846 aa, Homo sapiens
  Payload ID: 17539
  Gene Symbol: TNS1
  Gene Name: tensin 1
  ENSP ID: ENSP00000394171
MEQLVKERKGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 87657 - protein, 102 aa, Homo sapiens
  Payload ID: 17539
  Gene Symbol: TNS1
  Gene Name: tensin 1
  ENSP ID: ENSP00000395615
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLN

SEQ ID NO: 87658 - protein, 487 aa, Homo sapiens
  Payload ID: 17539
  Gene Symbol: TNS1
  Gene Name: tensin 1
  ENSP ID: ENSP00000400383
MVSPLPPPHCPGAALHVQPYKAAASHGPHGASPGGAGSMPLKLVGKVLLKGSTRVTPSVQPHLQPIRNMSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTD

SEQ ID NO: 87659 - protein, 61 aa, Homo sapiens
  Payload ID: 17539
  Gene Symbol: TNS1
  Gene Name: tensin 1
  ENSP ID: ENSP00000404477
MSVSRTMEDSCELDLVYVTERIIAVSFPSTANEENFRSNLREVAQMLKSKHGGNYLLFNLS

SEQ ID NO: 87660 - protein, 780 aa, Homo sapiens
  Payload ID: 17539
  Gene Symbol: TNS1
  Gene Name: tensin 1
  ENSP ID: ENSP00000405460
MTWICLSCMLWPEDLEAPKTHRFKVKTFKKVKPCGICRQVITQEGCTCKVCSFSCHRKCQAKVAAPCVPPSNHELVPITTENAPKNVVDKGEGASRGGNTRKSLEDNGSTRVTPSVQPHLQPIRNMSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQ

SEQ ID NO: 87661 - protein, 1714 aa, Homo sapiens
  Payload ID: 17539
  Gene Symbol: TNS1
  Gene Name: tensin 1
  ENSP ID: ENSP00000406016
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 87662 - protein, 1721 aa, Homo sapiens
  Payload ID: 17539
  Gene Symbol: TNS1
  Gene Name: tensin 1
  ENSP ID: ENSP00000408724
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 87663 - protein, 122 aa, Homo sapiens
  Payload ID: 17539
  Gene Symbol: TNS1
  Gene Name: tensin 1
  ENSP ID: ENSP00000411349
MQVAAPCVPPSNHELVPITTENAPKNVVDKGEGASRGGNTRKSLEDNGSTRVTPSVQPHLQPIRNMSVSRTMEDSCELDLVYVTERIIAVSFPSTANEENFRSNLREVAQMLKSKHGGNYLV

SEQ ID NO: 87664 - protein, 149 aa, Homo sapiens
  Payload ID: 17539
  Gene Symbol: TNS1
  Gene Name: tensin 1
  ENSP ID: ENSP00000414704
  MOD_RES (1)..(1): Any amino acid
XGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEGAQHPQIGQDTPPGPSDPPGCL

SEQ ID NO: 87665 - protein, 1365 aa, Homo sapiens
  Payload ID: 17539
  Gene Symbol: TNS1
  Gene Name: tensin 1
  ENSP ID: ENSP00000480559
MEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 87666 - protein, 1721 aa, Homo sapiens; identical to SEQ ID NO: 87662
  Payload ID: 17539
  Gene Symbol: TNS1
  Gene Name: tensin 1
  ENSP ID: ENSP00000484271

SEQ ID NO: 87667 - protein, 1409 aa, Homo sapiens
  Payload ID: 17540
  Gene Symbol: TNS2
  Gene Name: tensin 2
  Uniprot ID: Q63HR2
  ENSP ID: ENSP00000319684
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 87668 - protein, 1419 aa, Homo sapiens
  Payload ID: 17540
  Gene Symbol: TNS2
  Gene Name: tensin 2
  Uniprot ID: Q63HR2
  ENSP ID: ENSP00000319756
MDGGGVCVGRGDLLSSPQALGQLLRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 87669 - protein, 1285 aa, Homo sapiens
  Payload ID: 17540
  Gene Symbol: TNS2
  Gene Name: tensin 2
  Uniprot ID: Q63HR2
  ENSP ID: ENSP00000369232
MERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 87670 - protein, 1407 aa, Homo sapiens
  Payload ID: 17540
  Gene Symbol: TNS2
  Gene Name: tensin 2
  Uniprot ID: Q63HR2
  ENSP ID: ENSP00000447021
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 87671 - protein, 34 aa, Homo sapiens
  Payload ID: 17540
  Gene Symbol: TNS2
  Gene Name: tensin 2
  ENSP ID: ENSP00000449165
  MOD_RES (1)..(1): Any amino acid
XESTRRQDTRSPTSAPTQRLSPGEALPPVSQLAQ

SEQ ID NO: 87672 - protein, 1344 aa, Homo sapiens
  Payload ID: 17540
  Gene Symbol: TNS2
  Gene Name: tensin 2
  ENSP ID: ENSP00000449361
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 87673 - protein, 1312 aa, Homo sapiens
  Payload ID: 17540
  Gene Symbol: TNS2
  Gene Name: tensin 2
  Uniprot ID: Q63HR2
  ENSP ID: ENSP00000449363
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 87674 - protein, 197 aa, Homo sapiens
  Payload ID: 17540
  Gene Symbol: TNS2
  Gene Name: tensin 2
  ENSP ID: ENSP00000473388
  MOD_RES (1)..(1): Any amino acid
XALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGAQAACRVGGSLTHTRGPLDGSPYAQVQRPPRQTPPAPSPEPPPPPMLSVSSDSGHSSTLTTEPAAESPGRPPPTAAERQELDR

SEQ ID NO: 87675 - protein, 1445 aa, Homo sapiens
  Payload ID: 17541
  Gene Symbol: TNS3
  Gene Name: tensin 3
  Uniprot ID: Q68CZ2
  ENSP ID: ENSP00000312143
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 87676 - protein, 21 aa, Homo sapiens
  Payload ID: 17541
  Gene Symbol: TNS3
  Gene Name: tensin 3
  ENSP ID: ENSP00000387990
  MOD_RES (1)..(1): Any amino acid
XIFCALDPQDRKWIKDGPSSK

SEQ ID NO: 87677 - protein, 108 aa, Homo sapiens
  Payload ID: 17541
  Gene Symbol: TNS3
  Gene Name: tensin 3
  ENSP ID: ENSP00000388142
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCR

SEQ ID NO: 87678 - protein, 250 aa, Homo sapiens
  Payload ID: 17541
  Gene Symbol: TNS3
  Gene Name: tensin 3
  Uniprot ID: Q68CZ2
  ENSP ID: ENSP00000388318
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVMNYNIANI

SEQ ID NO: 87679 - protein, 250 aa, Homo sapiens; identical to SEQ ID NO: 87678
  Payload ID: 17541
  Gene Symbol: TNS3
  Gene Name: tensin 3
  Uniprot ID: Q68CZ2
  ENSP ID: ENSP00000389285

SEQ ID NO: 87680 - protein, 544 aa, Homo sapiens
  Payload ID: 17541
  Gene Symbol: TNS3
  Gene Name: tensin 3
  ENSP ID: ENSP00000396914
MPEELTSSLHAFKNKAFKKSKVCGVCKQIIDGQGISCRACKYSCHKKCEAKVVIPCGVQVRLEQAPGSSTLSSSLCRDKPLRPVILSPTMEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTR

SEQ ID NO: 87681 - protein, 114 aa, Homo sapiens
  Payload ID: 17541
  Gene Symbol: TNS3
  Gene Name: tensin 3
  ENSP ID: ENSP00000407464
MCSRQRSGFGCITNWWKMGTRHPAHPAQPEELTSSLHAFKNKAFKKSKVCGVCKQIIDGQGISCRACKYSCHKKCEAKVVIPCGVQVRLEQAPGSSTLSSSLCRDKPLRPVILS

SEQ ID NO: 87682 - protein, 138 aa, Homo sapiens
  Payload ID: 17541
  Gene Symbol: TNS3
  Gene Name: tensin 3
  ENSP ID: ENSP00000409415
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRF

SEQ ID NO: 87683 - protein, 1249 aa, Homo sapiens
  Payload ID: 17541
  Gene Symbol: TNS3
  Gene Name: tensin 3
  ENSP ID: ENSP00000414358
MNWLCRNQDPNPPPQPEELTSSLHAFKNKAFKKSKVCGVCKQIIDGQGISCRACKYSCHKKCEAKVVIPCGVQVRLEQAPGSSTLSSSLCRDKPLRPVILSPTMEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASE

SEQ ID NO: 87684 - protein, 715 aa, Homo sapiens
  Payload ID: 17542
  Gene Symbol: TNS4
  Gene Name: tensin 4
  Uniprot ID: Q8IZW8
  ENSP ID: ENSP00000254051
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLESPANSSSSLHSLGSVSLCTRPSDFQAPRNPTLTMGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 87685 - protein, 33 aa, Homo sapiens
  Payload ID: 17542
  Gene Symbol: TNS4
  Gene Name: tensin 4
  ENSP ID: ENSP00000463456
  MOD_RES (1)..(1): Any amino acid
XVFFRRHYPLTTLRFCGMDPEQRKWQKYCKPSW

SEQ ID NO: 87686 - protein, 188 aa, Homo sapiens
  Payload ID: 17543
  Gene Symbol: TDGF1
  Gene Name: teratocarcinoma-derived growth factor 1
  Uniprot ID: P13385
  ENSP ID: ENSP00000296145
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 87687 - protein, 172 aa, Homo sapiens
  Payload ID: 17543
  Gene Symbol: TDGF1
  Gene Name: teratocarcinoma-derived growth factor 1
  ENSP ID: ENSP00000446375
MAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 87688 - protein, 451 aa, Homo sapiens
  Payload ID: 17544
  Gene Symbol: TINF2
  Gene Name: TERF1 (TRF1)-interacting nuclear factor 2
  Uniprot ID: Q9BSI4
  ENSP ID: ENSP00000267415
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKENCLDCYMDPLRLSLLPPRARKPVCPPSLCSSVITIGDLVLDSDEEENGQGEGKESLENYQKTKFDTLIPTLCEYLPPSGHGAIPVSSCDCRDSSRPL

SEQ ID NO: 87689 - protein, 354 aa, Homo sapiens
  Payload ID: 17544
  Gene Symbol: TINF2
  Gene Name: TERF1 (TRF1)-interacting nuclear factor 2
  Uniprot ID: Q9BSI4
  ENSP ID: ENSP00000382350
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 87690 - protein, 146 aa, Homo sapiens
  Payload ID: 17544
  Gene Symbol: TINF2
  Gene Name: TERF1 (TRF1)-interacting nuclear factor 2
  ENSP ID: ENSP00000452724
MEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRN

SEQ ID NO: 87691 - protein, 274 aa, Homo sapiens
  Payload ID: 17544
  Gene Symbol: TINF2
  Gene Name: TERF1 (TRF1)-interacting nuclear factor 2
  ENSP ID: ENSP00000452800
  MOD_RES (1)..(1): Any amino acid
XAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRTLGGRALKENPVDLPATEQKE

SEQ ID NO: 87692 - protein, 140 aa, Homo sapiens
  Payload ID: 17544
  Gene Symbol: TINF2
  Gene Name: TERF1 (TRF1)-interacting nuclear factor 2
  ENSP ID: ENSP00000453025
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQSALLLTQ

SEQ ID NO: 87693 - protein, 85 aa, Homo sapiens
  Payload ID: 17544
  Gene Symbol: TINF2
  Gene Name: TERF1 (TRF1)-interacting nuclear factor 2
  ENSP ID: ENSP00000453113
GGRALKENPVDLPATEQKENCLDCYMDPLRLSLLPPRARKPVCPPSLCSSVITIGDLVLDSDEEENGQGEGKVSGKEQKAGKGDG

SEQ ID NO: 87694 - protein, 91 aa, Homo sapiens
  Payload ID: 17544
  Gene Symbol: TINF2
  Gene Name: TERF1 (TRF1)-interacting nuclear factor 2
  ENSP ID: ENSP00000453157
MATPLVAGPAALRFAAAASWQVVRGRCVEHFPRVLEFLRSLRAVAPGLVRYRHHERLCMGLKAKTKQDLRKILEAQETFYQQVKQLSEAPV

SEQ ID NO: 87695 - protein, 71 aa, Homo sapiens
  Payload ID: 17544
  Gene Symbol: TINF2
  Gene Name: TERF1 (TRF1)-interacting nuclear factor 2
  ENSP ID: ENSP00000453675
MATPLVAGPAALRFAAAASWQVVRGRCVEHFPRVLEFLRSLRAVAPGLVRYRHHERLCMGLKAKSALLLTQ

SEQ ID NO: 87696 - protein, 140 aa, Homo sapiens; identical to SEQ ID NO: 87692
  Payload ID: 17544
  Gene Symbol: TINF2
  Gene Name: TERF1 (TRF1)-interacting nuclear factor 2
  ENSP ID: ENSP00000486681

SEQ ID NO: 87697 - protein, 165 aa, Homo sapiens
  Payload ID: 17545
  Gene Symbol: TUT1
  Gene Name: terminal uridylyl transferase 1, U6 snRNA-specific
  ENSP ID: ENSP00000278279
MAAVDSDVESLPRGGFRCCLCHVTTANRPSLDAHLGGRKHRHLVELRAARKAQGLRSVFVSGFPRDVDSAQLSEYFLAFGPVASVVMDKDKPVPKAPESPSLDSALASPLDPQALACTPASPPDSQPPASPQDSEALDFETPSSSLAPQTPDSALASETLASPQS

SEQ ID NO: 87698 - protein, 912 aa, Homo sapiens
  Payload ID: 17545
  Gene Symbol: TUT1
  Gene Name: terminal uridylyl transferase 1, U6 snRNA-specific
  ENSP ID: ENSP00000308000
MSLPIGSAEVASERVELWRSGFRWWQRCLCFCRYRRVAMAAVDSDVESLPRGGFRCCLCHVTTANRPSLDAHLGGRKHRHLVELRAARKAQGLRSVFVSGFPRDVDSAQLSEYFLAFGPVASVVMDKDKGVFAIVEMGDVGAREAVLSQSQHSLGGHRLRVRPREQKEFQSPASKSPKGAAPDSHQLAKALAEAADVGAQMIKLVGLRELSEAERQLRSLVVALMQEVFTEFFPGCVVHPFGSSINSFDVHGCDLDLFLDLGDLEEPQPVPKAPESPSLDSALASPLDPQALACTPASPPDSQPPASPQDSEALDFETPSSSLAPQTPDSALASETLASPQSLPPASPLLEDREEGDLGKASELAETPKEEKAEGAAMLELVGSILRGCVPGVYRVQTVPSARRPVVKFCHRPSGLHGDVSLSNRLALHNSRFLSLCSELDGRVRPLVYTLRCWAQGRGLSGSGPLLSNYALTLLVIYFLQTRDPPVLPTVSQLTQKAGEGEQVEVDGWDCSFPRDASRLEPSINVEPLSSLLAQFFSCVSCWDLRGSLLSLREGQALPVAGGLPSNLWEGLRLGPLNLQDPFDLSHNVAANVTSRVAGRLQNCCRAAANYCRSLQYQRRSSRGRDWGLLPLLQPSSPSSLLSATPIPLPLAPFTQLTAALVQVFREALGCHIEQATKRTRSEGGGTGESSQGGTSKRLKVDGQKNCCEEGKEEQQGCAGDGGEDRVEEMVIEVGEMVQDWAMQSPGQPGDLPLTTGKHGAPGEEGQPSHAALAERGPKGHEAAQEWSQGEAGKGASLPSSASWRCALWHRVWQGRRRARRRLQQQTKEGAGGGAGTRAGWLATEAQVTQELKGLSGGEERPETEPLLSFVASVSPADRMLTVTPLQDPQGLFPDLHHFLQVFLPQAIRHLK

SEQ ID NO: 87699 - protein, 874 aa, Homo sapiens
  Payload ID: 17545
  Gene Symbol: TUT1
  Gene Name: terminal uridylyl transferase 1, U6 snRNA-specific
  Uniprot ID: Q9H6E5
  ENSP ID: ENSP00000419607
MAAVDSDVESLPRGGFRCCLCHVTTANRPSLDAHLGGRKHRHLVELRAARKAQGLRSVFVSGFPRDVDSAQLSEYFLAFGPVASVVMDKDKGVFAIVEMGDVGAREAVLSQSQHSLGGHRLRVRPREQKEFQSPASKSPKGAAPDSHQLAKALAEAADVGAQMIKLVGLRELSEAERQLRSLVVALMQEVFTEFFPGCVVHPFGSSINSFDVHGCDLDLFLDLGDLEEPQPVPKAPESPSLDSALASPLDPQALACTPASPPDSQPPASPQDSEALDFETPSSSLAPQTPDSALASETLASPQSLPPASPLLEDREEGDLGKASELAETPKEEKAEGAAMLELVGSILRGCVPGVYRVQTVPSARRPVVKFCHRPSGLHGDVSLSNRLALHNSRFLSLCSELDGRVRPLVYTLRCWAQGRGLSGSGPLLSNYALTLLVIYFLQTRDPPVLPTVSQLTQKAGEGEQVEVDGWDCSFPRDASRLEPSINVEPLSSLLAQFFSCVSCWDLRGSLLSLREGQALPVAGGLPSNLWEGLRLGPLNLQDPFDLSHNVAANVTSRVAGRLQNCCRAAANYCRSLQYQRRSSRGRDWGLLPLLQPSSPSSLLSATPIPLPLAPFTQLTAALVQVFREALGCHIEQATKRTRSEGGGTGESSQGGTSKRLKVDGQKNCCEEGKEEQQGCAGDGGEDRVEEMVIEVGEMVQDWAMQSPGQPGDLPLTTGKHGAPGEEGQPSHAALAERGPKGHEAAQEWSQGEAGKGASLPSSASWRCALWHRVWQGRRRARRRLQQQTKEGAGGGAGTRAGWLATEAQVTQELKGLSGGEERPETEPLLSFVASVSPADRMLTVTPLQDPQGLFPDLHHFLQVFLPQAIRHLK

SEQ ID NO: 87700 - protein, 100 aa, Homo sapiens
  Payload ID: 17545
  Gene Symbol: TUT1
  Gene Name: terminal uridylyl transferase 1, U6 snRNA-specific
  ENSP ID: ENSP00000419792
MAAVDSDVESLPRGGFRCCLCHVTTANRPSLDAHLGGRKHRHLVELRAARKAQGLRSVFVSGFPRDVDSAQLSEYFLAFGPVASVVMDKDKGLAVSQAGV

SEQ ID NO: 87701 - protein, 143 aa, Homo sapiens
  Payload ID: 17545
  Gene Symbol: TUT1
  Gene Name: terminal uridylyl transferase 1, U6 snRNA-specific
  ENSP ID: ENSP00000420739
MDKDKGVFAIVEMGDVGAREAVLSQSQHSLGGHRLRVRPREQKEFQSPASKSPKGAAPDSHQLAKALAEAADVGAQMIKLVGLRELSEAERQLRSLVVALMQEVFTEFFPGCVVHPFGSSINSFDVHGCDLDLFLDLGDLEEP

SEQ ID NO: 87702 - protein, 214 aa, Homo sapiens
  Payload ID: 17546
  Gene Symbol: TESC
  Gene Name: tescalcin
  Uniprot ID: Q96BS2
  ENSP ID: ENSP00000334785
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 87703 - protein, 135 aa, Homo sapiens
  Payload ID: 17546
  Gene Symbol: TESC
  Gene Name: tescalcin
  ENSP ID: ENSP00000432608
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRSCGFLGLEGGCAVDVKQGP

SEQ ID NO: 87704 - protein, 163 aa, Homo sapiens
  Payload ID: 17546
  Gene Symbol: TESC
  Gene Name: tescalcin
  Uniprot ID: Q96BS2
  ENSP ID: ENSP00000432716
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVKWSRSCCRETLTSRRSPLAPSPTGP

SEQ ID NO: 87705 - protein, 187 aa, Homo sapiens
  Payload ID: 17546
  Gene Symbol: TESC
  Gene Name: tescalcin
  Uniprot ID: Q96BS2
  ENSP ID: ENSP00000445689
MGAAHSASEEVRELEGKTGFSSDQIEQLHRRFKQLSGDQPTIRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 87706 - protein, 81 aa, Homo sapiens
  Payload ID: 17546
  Gene Symbol: TESC
  Gene Name: tescalcin
  ENSP ID: ENSP00000450386
PHVRLGQRRPHHSGRISKCKVVEELLSGNPHIEKESARSIADGAMMEAASVCMGQMIWQGIDIETKMHVRFLNMETMALCH

SEQ ID NO: 87707 - protein, 421 aa, Homo sapiens
  Payload ID: 17547
  Gene Symbol: TES
  Gene Name: testin LIM domain protein
  Uniprot ID: Q9UGI8
  ENSP ID: ENSP00000350937
MDLENKVKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 87708 - protein, 412 aa, Homo sapiens
  Payload ID: 17547
  Gene Symbol: TES
  Gene Name: testin LIM domain protein
  Uniprot ID: Q9UGI8
  ENSP ID: ENSP00000377121
MGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 87709 - protein, 192 aa, Homo sapiens
  Payload ID: 17547
  Gene Symbol: TES
  Gene Name: testin LIM domain protein
  ENSP ID: ENSP00000377124
  MOD_RES (1)..(1): Any amino acid
XTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVRSVLRIWLPQPALGLEFMLFLKPLTNGKQKAVLLSRKQIIPTTGC

SEQ ID NO: 87710 - protein, 79 aa, Homo sapiens
  Payload ID: 17547
  Gene Symbol: TES
  Gene Name: testin LIM domain protein
  ENSP ID: ENSP00000413002
MYKRNVMILTNPVAAKKNVSINTVTYEWAPPVQNQALARQYMQMLPKEKQPVAGSEGAQYRKKQLAKQLPAHDQDPSKC

SEQ ID NO: 87711 - protein, 44 aa, Homo sapiens
  Payload ID: 17547
  Gene Symbol: TES
  Gene Name: testin LIM domain protein
  ENSP ID: ENSP00000420220
MDLENKVKKMGLGHEQGFGAPCLKCKEKCEGFELHFWSPAIAAN

SEQ ID NO: 87712 - protein, 1692 aa, Homo sapiens
  Payload ID: 17548
  Gene Symbol: TOPAZ1
  Gene Name: testis and ovary specific PAZ domain containing 1
  Uniprot ID: Q8N9V7
  ENSP ID: ENSP00000310303
MRRPPPLGPTTASGPEGNVRNLQKRQAPGPGAAGGCGPEAGGCRENKQKRRMVARATPGRGEVESDKSVAASGAGKAARRQVEGRRGPVSPSDSSDPRGLEAAKEAELPLQTERHTKEKRKVTEASSDDPQPGLDLVRKESLTSSESFQTVECLQSLGKESIIEGIKRRIRNKKLKSLENPPLKITENEATQNIKVEFQDELYKNTPKYSCNILSPEVENNSVLKLRDCNCFPHSKGCNDENNLPYKPDGGCMHVAENFSKKENLRSLAEKSDTNSIPQLLQTEENVMGVNKLLPEESDLYQSKTNGLLSCLQHEKNKYSIEESSVGRKPRKRMKLSEKADETVTEMNFSNEYNKSELMLQENQMIADGKEAETKSPLNVLRKVSHNTVSLMDHLLSVPETVEKETSSEHHVNAVFQKTIEPLLKEETENASEPLGYESMASKEDFKSMKSFIGKSPNEYHIERRSSREDLRSASEELKLSCQRTIPMTGKRTWPYYSCARISAWCWKKASLPESSYFLRGSQESCRQVDVPKHQTNQTHLTDSKLLLQSSLTETNTESSSKEKLDSNSNCLSSVSAVEPTLMVIKEPIIKDDKKIKSEELSRRGSEVISNTTEDTQLTSETQSLTGNKKKARGNLTKLNLTATSKDGQEANNSAGKTIHRKACIAQQTFIVPDLVKILNTGRLTNFKIPLLKNKSEKRKEVNAKSSEREAYSPLELLDNLSGADVRQNRSKENVSMMMLGPQTLSIRNSVTPVQASSDSFYNKKSYSISPSFTKQGNNSKPSNHVSEPGNIVSNKEVASLTVENNAFSCDPGYVEKSPSFCCNEQETFRPVSSEVRGRKITKNFSEVGFPDILKAYEDDVLLIDVIQDDPDLFGVSNEGELSFTSEVPKISQEPNVAGEHQSTDSKYMETPVKKEPSDDLRELPVLDCGWIKPDICASNSAESEIKRDPKDVNTSLGEVANETSENETLGDFSEQIKGSDLDEKHRFTDKVITKEEKENIYEVCKSKDSRNADFMVGECQFAVPVPKPLCLLVPPLNLSGRQEDTILNTWMNDFRFLGKHSVLKLQNPETCEIFKREKNVGVFQKSLGLMIPYKYCKFHFNTLRGCERPLCKFAHVPEQGDEKVCMDVFKKYININELCLLQRAVNIFMEYYRKFPPGVYFDLQVLNDLLNSLLKHCLLKEVFQIVNLSIMVKMLPSLKILLNIFEYVATMKLRNAVPALIDIFCKLVEAGMVLDPEHFNYIVKLLYQVQASKQEITAVLEMKSRLQMRRFKKNWKCDLDSALNKLEHCKEKGDWTKLGKLYINVKMGCEKFADFQTFCACIAETLTKNYEDERPDIPFCEFAETVSKDPQNSKVDKGVLGRIGISAMYFYHKLLQWSKGRKVLEKLYELKIHFTSLKGLIGPEKLASRCQIVNVAAEIFLKSGSLDGAIWVMRESEWIINTPLWPCDRLDVLNRHNLLCTIAHEILAKSLYRQTFEVLQNLPGFQNSQETVEVSQYSLLFNKLLGSCIESSSLGMSSSVAEFMISKSIPIDFSFLRRLITSLGRSRLWLKARAHYKSALSLGCYPPLEGNLYRKLLLIPSYLSEIEMLLAIEIFMVSNASSIQSPGTSTQILQIVLKRCEDNQSRSNDDYQAAVERLIMAARISDPKLFVKHMTVNVNKEQVYSLEHCSALKWLKENMKWAGKVWLFSNH

SEQ ID NO: 87713 - protein, 185 aa, Homo sapiens
  Payload ID: 17549
  Gene Symbol: TDRP
  Gene Name: testis development related protein
  Uniprot ID: Q86YL5
  ENSP ID: ENSP00000315111
MWKLGRGRVLLDEPPEEEDGLRGGPPPAAAAAAQAQVQGASFRGWKEVTSLFNKDDEQHLLERCKSPKSKGTNLRLKEELKAEKKSGFWDNLVLKQNIQSKKPDEIEGWEPPKLALEDISADPEDTVGGHPSWSGWEDDAKGSTKYTSLASSANSSRWSLRAAGRLVSIRRQSKGHLTDSPEEAE

SEQ ID NO: 87714 - protein, 198 aa, Homo sapiens
  Payload ID: 17549
  Gene Symbol: TDRP
  Gene Name: testis development related protein
  Uniprot ID: Q86YL5
  ENSP ID: ENSP00000408126
MWKLGRGRVLLDEPPEEEDGLRGGPPPAAAAAAQAQVQGASFRGWKEVTSLFNKDDEQHLLERCKSPKSKGTNLRLKEELKAEKKSGFWDNLVLKQNIQSKKPDEIEGWEPPKLALEDISADPEDTVGGHPSWSGWEDDAKGSTKYTSLASSANSSRWSLRAAGRLIKEVWINFSQLIISFRKHCLAHYRELRLCIKY

SEQ ID NO: 87715 - protein, 198 aa, Homo sapiens; identical to SEQ ID NO: 87714
  Payload ID: 17549
  Gene Symbol: TDRP
  Gene Name: testis development related protein
  Uniprot ID: Q86YL5
  ENSP ID: ENSP00000430325

SEQ ID NO: 87716 - protein, 185 aa, Homo sapiens; identical to SEQ ID NO: 87713
  Payload ID: 17549
  Gene Symbol: TDRP
  Gene Name: testis development related protein
  Uniprot ID: Q86YL5
  ENSP ID: ENSP00000479558

SEQ ID NO: 87717 - protein, 929 aa, Homo sapiens
  Payload ID: 17550
  Gene Symbol: TEX10
  Gene Name: testis expressed 10
  Uniprot ID: Q9NXF1
  ENSP ID: ENSP00000364037
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 87718 - protein, 171 aa, Homo sapiens
  Payload ID: 17550
  Gene Symbol: TEX10
  Gene Name: testis expressed 10
  ENSP ID: ENSP00000399872
MQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKF

SEQ ID NO: 87719 - protein, 913 aa, Homo sapiens
  Payload ID: 17550
  Gene Symbol: TEX10
  Gene Name: testis expressed 10
  Uniprot ID: Q9NXF1
  ENSP ID: ENSP00000444555
MSRMTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 87720 - protein, 267 aa, Homo sapiens
  Payload ID: 17551
  Gene Symbol: TEX101
  Gene Name: testis expressed 101
  Uniprot ID: Q9BY14
  ENSP ID: ENSP00000472308
MGARQIQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 87721 - protein, 249 aa, Homo sapiens
  Payload ID: 17551
  Gene Symbol: TEX101
  Gene Name: testis expressed 101
  Uniprot ID: Q9BY14
  ENSP ID: ENSP00000472769
MGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 87722 - protein, 940 aa, Homo sapiens
  Payload ID: 17552
  Gene Symbol: TEX11
  Gene Name: testis expressed 11
  Uniprot ID: Q8IYF3
  ENSP ID: ENSP00000340995
MISAHCNLRLLCSSDSSASASQVAGTTEVVENLVTNDNSPNIPEAIDRLFSDIANINRESMAEITDIQIEEMAVNLWNWALTIGGGWLVNEEQKIRLHYVACKLLSMCEASFASEQSIQRLIMMNMRIGKEWLDAGNFLIADECFQAAVASLEQLYVKLIQRSSPEADLTMEKITVESDHFRVLSYQAESAVAQGDFQRASMCVLQCKDMLMRLPQMTSSLHHLCYNFGVETQKNNKYEESSFWLSQSYDIGKMDKKSTGPEMLAKVLRLLATNYLDWDDTKYYDKALNAVNLANKEHLSSPGLFLKMKILLKGETSNEELLEAVMEILHLDMPLDFCLNIAKLLMDHERESVGFHFLTIIHERFKSSENIGKVLILHTDMLLQRKEELLAKEKIEEIFLAHQTGRQLTAESMNWLHNILWRQAASSFEVQNYTDALQWYYYSLRFYSTDEMDLDFTKLQRNMACCYLNLQQLDKAKEAVAEAERHDPRNVFTQFYIFKIAVIEGNSERALQAIITLENILTDEESEDNDLVAERGSPTMLLSLAAQFALENGQQIVAEKALEYLAQHSEDQEQVLTAVKCLLRFLLPKIAEMPESEDKKKEMDRLLTCLNRAFVKLSQPFGEEALSLESRANEAQWFRKTAWNLAVQCDKDPVMMREFFILSYKMSQFCPSDQVILIARKTCLLMAVAVDLEQGRKASTAFEQTMFLSRALEEIQTCNDIHNFLKQTGTFSNDSCEKLLLLYEFEVRAKLNDPLLESFLESVWELPHLETKTFETIAIIAMEKPAHYPLIALKALKKALLLYKKEEPIDISQYSKCMHNLVNLSVPDGASNVELCPLEEVWGYFEDALSHISRTKDYPEMEILWLMVKSWNTGVLMFSRSKYASAEKWCGLALRFLNHLTSFKESYETQMNMLYSQLVEALSNNKGPVFHEHGYWSKSD

SEQ ID NO: 87723 - protein, 615 aa, Homo sapiens
  Payload ID: 17552
  Gene Symbol: TEX11
  Gene Name: testis expressed 11
  Uniprot ID: Q8IYF3
  ENSP ID: ENSP00000363440
MEILHLDMPLDFCLNIAKLLMDHERESVGFHFLTIIHERFKSSENIGKVLILHTDMLLQRKEELLAKEKIEEIFLAHQTGRQLTAESMNWLHNILWRQAASSFEVQNYTDALQWYYYSLRFYSTDEMDLDFTKLQRNMACCYLNLQQLDKAKEAVAEAERHDPRNVFTQFYIFKIAVIEGNSERALQAIITLENILTDEESEDNDLVAERGSPTMLLSLAAQFALENGQQIVAEKALEYLAQHSEDQEQVLTAVKCLLRFLLPKIAEMPESEDKKKEMDRLLTCLNRAFVKLSQPFGEEALSLESRANEAQWFRKTAWNLAVQCDKDPVMMREFFILSYKMSQFCPSDQVILIARKTCLLMAVAVDLEQGRKASTAFEQTMFLSRALEEIQTCNDIHNFLKQTGTFSNDSCEKLLLLYEFEVRAKLNDPLLESFLESVWELPHLETKTFETIAIIAMEKPAHYPLIALKALKKALLLYKKEEPIDISQYSKCMHNLVNLSVPDGASNVELCPLEEVWGYFEDALSHISRTKDYPEMEILWLMVKSWNTGVLMFSRSKYASAEKWCGLALRFLNHLTSFKESYETQMNMLYSQLVEALSNNKGPVFHEHGYWSKSD

SEQ ID NO: 87724 - protein, 925 aa, Homo sapiens
  Payload ID: 17552
  Gene Symbol: TEX11
  Gene Name: testis expressed 11
  Uniprot ID: Q8IYF3
  ENSP ID: ENSP00000363453
MDNDDFFSMDFKEVVENLVTNDNSPNIPEAIDRLFSDIANINRESMAEITDIQIEEMAVNLWNWALTIGGGWLVNEEQKIRLHYVACKLLSMCEASFASEQSIQRLIMMNMRIGKEWLDAGNFLIADECFQAAVASLEQLYVKLIQRSSPEADLTMEKITVESDHFRVLSYQAESAVAQGDFQRASMCVLQCKDMLMRLPQMTSSLHHLCYNFGVETQKNNKYEESSFWLSQSYDIGKMDKKSTGPEMLAKVLRLLATNYLDWDDTKYYDKALNAVNLANKEHLSSPGLFLKMKILLKGETSNEELLEAVMEILHLDMPLDFCLNIAKLLMDHERESVGFHFLTIIHERFKSSENIGKVLILHTDMLLQRKEELLAKEKIEEIFLAHQTGRQLTAESMNWLHNILWRQAASSFEVQNYTDALQWYYYSLRFYSTDEMDLDFTKLQRNMACCYLNLQQLDKAKEAVAEAERHDPRNVFTQFYIFKIAVIEGNSERALQAIITLENILTDEESEDNDLVAERGSPTMLLSLAAQFALENGQQIVAEKALEYLAQHSEDQEQVLTAVKCLLRFLLPKIAEMPESEDKKKEMDRLLTCLNRAFVKLSQPFGEEALSLESRANEAQWFRKTAWNLAVQCDKDPVMMREFFILSYKMSQFCPSDQVILIARKTCLLMAVAVDLEQGRKASTAFEQTMFLSRALEEIQTCNDIHNFLKQTGTFSNDSCEKLLLLYEFEVRAKLNDPLLESFLESVWELPHLETKTFETIAIIAMEKPAHYPLIALKALKKALLLYKKEEPIDISQYSKCMHNLVNLSVPDGASNVELCPLEEVWGYFEDALSHISRTKDYPEMEILWLMVKSWNTGVLMFSRSKYASAEKWCGLALRFLNHLTSFKESYETQMNMLYSQLVEALSNNKGPVFHEHGYWSKSD

SEQ ID NO: 87725 - protein, 940 aa, Homo sapiens; identical to SEQ ID NO: 87722
  Payload ID: 17552
  Gene Symbol: TEX11
  Gene Name: testis expressed 11
  Uniprot ID: Q8IYF3
  ENSP ID: ENSP00000379226

SEQ ID NO: 87726 - protein, 123 aa, Homo sapiens
  Payload ID: 17553
  Gene Symbol: TEX12
  Gene Name: testis expressed 12
  Uniprot ID: Q9BXU0
  ENSP ID: ENSP00000280358
MMANHLVKPDNRNCKRPRELESPVPDSPQLSSLGKSDSSFSEISGLFYKDEALEKDLNDVSKEINLMLSTYAKLLSERAAVDASYIDEIDELFKEANAIENFLIQKREFLRQRFTVIANTLHR

SEQ ID NO: 87727 - protein, 123 aa, Homo sapiens; identical to SEQ ID NO: 87726
  Payload ID: 17553
  Gene Symbol: TEX12
  Gene Name: testis expressed 12
  Uniprot ID: Q9BXU0
  ENSP ID: ENSP00000436893

SEQ ID NO: 87728 - protein, 409 aa, Homo sapiens
  Payload ID: 17554
  Gene Symbol: TEX13A
  Gene Name: testis expressed 13A
  Uniprot ID: Q9BXU3
  ENSP ID: ENSP00000471604
MALRPEDPSSGFRHSNVVAFINEKMARHTKGPEFYLENISLSWEKVEDKLRAILEDSEVPSEVKEACTWGSLALGVRFAHRQAQLQRHRVRWLHGFAKLHKSAAQALASDLKKLREQQETERKEAASRLRMAQTSLVEVQKERDKELVSPHEWEQGAGWPGLATAGGVCTEGAAEEEEEAAVAAAGAAGGKGAEEEQRDVEVVAAPVEAMAPPVEAGAAPMETQFPHVEARAASMETTEKLERILLQLLGDADQEKYTYWGQKEGDLRSVETATSYFSGTTNPWSRASSEPLPVQLPASYSYSYSSPFSSFSDIPTISPPQATVTAPVPPQLPSDWEAFDTSLWSDGGPHRIDHQEHPRDRRYSEPHQQRPPVYRRPGDWDCPWCNAVNFSRRDTCFDCGKGIWLQKPH

SEQ ID NO: 87729 - protein, 409 aa, Homo sapiens; identical to SEQ ID NO: 87728
  Payload ID: 17554
  Gene Symbol: TEX13A
  Gene Name: testis expressed 13A
  Uniprot ID: Q9BXU3
  ENSP ID: ENSP00000477478

SEQ ID NO: 87730 - protein, 312 aa, Homo sapiens
  Payload ID: 17555
  Gene Symbol: TEX13B
  Gene Name: testis expressed 13B
  Uniprot ID: Q9BXU2
  ENSP ID: ENSP00000303777
MALRPEDPSSGFRHGNVVAFIIEKMARHTKGPEFYFENISLSWEEVEDKLRAILEDSEVPSEVKEACTWGSLALGVRFAHRQGQLQNRRVQWLQGFAKLHRSAALVLASNLTELKEQQEMECNEATFQLQLTETSLAEVQRERDMLRWKLFHAELAPPQGQGQATVFPGLATAGGDWTEGAGEQEKEAVAAAGAAGGKGEERYAEAGPAPAEVLQGLGGGFRQPLGAIVAGKLHLCGAEGERSQVSTNSHVCLLWAWVHSLTGASSCPAPYLIHILIPMPFVRLLSHTQYTPFTSKGHRTGSNSDAFQLGGL

SEQ ID NO: 87731 - protein, 1497 aa, Homo sapiens
  Payload ID: 17556
  Gene Symbol: TEX14
  Gene Name: testis expressed 14
  Uniprot ID: Q8IWB6
  ENSP ID: ENSP00000240361
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKAMPWFQFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSHQSMQSTCSPESSEDITDEFLTPDGEYFYSSTAQENLALETSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 87732 - protein, 1451 aa, Homo sapiens
  Payload ID: 17556
  Gene Symbol: TEX14
  Gene Name: testis expressed 14
  Uniprot ID: Q8IWB6
  ENSP ID: ENSP00000268910
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSTSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 87733 - protein, 1491 aa, Homo sapiens
  Payload ID: 17556
  Gene Symbol: TEX14
  Gene Name: testis expressed 14
  Uniprot ID: Q8IWB6
  ENSP ID: ENSP00000374584
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSHQSMQSTCSPESSEDITDEFLTPDGEYFYSSTAQENLALETSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 87734 - protein, 152 aa, Homo sapiens
  Payload ID: 17556
  Gene Symbol: TEX14
  Gene Name: testis expressed 14
  ENSP ID: ENSP00000463243
  MOD_RES (1)..(1): Any amino acid
XKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIVAV

SEQ ID NO: 87735 - protein, 66 aa, Homo sapiens
  Payload ID: 17556
  Gene Symbol: TEX14
  Gene Name: testis expressed 14
  ENSP ID: ENSP00000463593
MSRAVRLPVPCPVQLGTLRNDSLEAQLHEYVKQGNYVKVKKILKKALELPQTALRSEEEWRSKEEN

SEQ ID NO: 87736 - protein, 2789 aa, Homo sapiens
  Payload ID: 17557
  Gene Symbol: TEX15
  Gene Name: testis expressed 15
  Uniprot ID: Q9BXT5
  ENSP ID: ENSP00000256246
MPSDAKDSVNGDLLLNWTSLKNILSGLNASFPLHNNTGSSTVTTSKSIKDPRLMRREESMGEQSSTAGLNEVLQFEKSSDNVNSEIKSTPSNSASSSEVVPGDCAVLTNGLDTPCFKTSVNDSQSWAHNMGSEDYDCIPPNKVTMAGQCKDQGNFSFPISVSNVVSEVENQNHSEEKAQRAQQESGNAYTKEYSSHIFQDSQSSDLKTIYQTGCQTSTVFPLKKKVSIDEYLQNTGKMKNFADLEDSSKHEEKQTSWKEIDNDFTNETKISPIDNYIVLHQEYKESESHNSFGKSCDKILITQELEITKSSTSTIKDKDELDHLALEWQITPSFESLSQKHPQHSVEYEGNIHTSLAIAQKLMELKLGKINQNYASIITEAFPKPKDIPQAKEMFIDTVISSYNIETAHDSSNCSITREHICVHRKNENEPVSLENIQRDYKETAYVEDRGQDHNLFCNSQLSNDIWLNVNFKKQTDRENQNEAKENSASCVENNIENIYGDKKQDSHTNENFSNIDEKEDKNYHNIEILSSEEFSTKFNLICREDNAVSAATALLESEEDTISAVKQKDTENTGRSVEHLASTTFPKTASSSVCVASNAAIQIASATMPALSLNNDDHQIYQFKETCSSESPDFGLLVKHRVSDCEIDTDKNKSQESFHQSINENLVLQSIELESEIEIELEDCDDAFIFQQDTHSHENMLCEEFVTSYKALKSRISWEGLLALDNGEMEVLESTTGRENSDQHYSKESNYFYSSTQNNETELTSPILLPDLQIKITNIFRPGFSPTADSLALKDSFCTHVTEATKPEINKEDGEILGFDIYSQPFGENADYPCEDKVDNIRQESGPVSNSEISLSFDLSRNTDVNHTSENQNSESLFTEPSNVTTIDDGSRCFFTKSKTDYNDTKNKKEVESRISKRKLHISSRDQNIPHKDLRRHKIYGRKRRLTSQDSSECFSSLSQGRIKTFSQSEKHIKSVLNILSDEASLCKSKCLSRKLDKAVVHLKKAHRRVHTSLQLITKVGEERKGPLPKSYAIICNNFWESCDLQGYSSVSQRKYYSTKHFSSKRKYDKRRKKRAPKADISKSLTHVSKHKSYKTSGEKKCLSRKSMASSVSKSHPTTSHMGEFCNQEHPESQLPVSSTSQSTSQSVYYNSSVSNPSLSEEHQPFSGKTAYLFSPDHSDEKLIEKENQIDTAFLSSTSKYEKLEKHSANHNVKDATKENSCDANEVINESNSVSLSCIKENINSSTGNDCDATCIGHTKAKTDVLISVLDSNVKHFLNDLYQQGNLILSDCKRNLEVKWTDPIERPKQNIITGNFLMGPLNLTLIASKKYSIPQLSAAAVTDSEGESSKSYLDKQRILTVDSFAASSTVPHCEQSCREKELLKTEQCSSGNCLHTDGNETNVTENYELDVASGTEEDKSYGENIVELSSSDSSLLLKDNVKGSSSETCIVKKDTEDRITWKVKQAEKAKDSVYKRSMTEGSTVNTEYKNQKNQISEESCLNEKIITTNLIDSHLSTKNTTTESVPLKNTVSNPLNKREKKGEIKVSKDSQSDLTLHSEIAYISKPGILGVNHTPILPAHSETCKVPTLLKKPASYVSDFKEKHCSANHTALIANLSQILQRADEASSLQILQEETKVCLNILPLFVEAFERKQECSVEQILISRELLVDQNLWNNCKHTLKPCAVDTLVELQMMMETIQFIENKKRHLEGEPTLRSLLWYDETLYAELLGKPRGFQQQSNFYPGFQGRLKYNAFCELQTYHDQLVELLEETKREKNSYYVFLKYKRQVNECEAIMEHCSDCFDFSLSVPFTCGVNFGDSLEDLEILRKSTLKLINVCGDSPKVHSYPGKQDHLWIIIEMISSKVNFIKNNEAVRVKISLYGLEHIFFDAAKNLVWKERTQSFSKKYSQKKDEERLLRVNKCAFSKLQKIYDTLSKDLNNEPISPIGLEEDTIIASRKSDHPINEATISIENSKFNSNLLAHPDICCISEILDQAEFADLKKLQDLTLRCTDHLEILKKYFQMLQDNNMDNIFITEENVLDVVINHSHEAIILKPEAIEMYIEIVMVSETIHFLKNSIAKKLDKQRFRGMLWFDLSLLPELVQCQEKMASFSFLKDNSTDVCLWKVIETAVSELKKDLDIICKYNEAVNCSYAIHLLSRELQELSEIKKLLKKSKYFISTYIDFVPYIASINYGSTVTELEYNYNQFSTLLKNVMSAPRKDLGKMAHIRKVMKTIEHMKMICTKNAELTISFFLCQMLYNRRKILQLKRKEKMNIHIVKPGENNNKFSISTMLPPVSECINKNISNSSKKRPSTVDKCEDSQEQQQDTTVSSCKKLKVDMKDVTKINREKATFKHPRTTGSHPKSENKIVPSSCDSLKRNHLTPKKVEMQRSLPGSLLPLENPKDTCASKSESKIDLTVSSDHFSGQQENLNSMKKRNVNFSAAETKSDKKDCAAFAICDQKSVHGTFSPDHGTLLQKFLKNSPDPTQKSCLSDINPETDVSLVPDASVLSKPIFCFVKDVHPDLEMNDTVFELQDNDIVNSSIKNSSCMTSPEPICIQNKIPTLQINKLQPTETESEDKYMKDTLNPNTVHTFGASGHITLNVNQGAEYSLSEQQNDKNSKVLMQNAATYWNELPQSACNPTYNSSEHLFGTSYPYSAWCVYQYSNSNGNAITQTYQGITSYEVQPSPSGLLTTVASTAQGTHSNLLYSQYFTYFAGEPQANGFVPVNGYFQSQIPASNFRQPIFSQYASHQPLPQATYPYLPNRFVPPEVPWVYAPWHQESFHPGH

SEQ ID NO: 87737 - protein, 164 aa, Homo sapiens
  Payload ID: 17558
  Gene Symbol: TEX19
  Gene Name: testis expressed 19
  Uniprot ID: Q8NA77
  ENSP ID: ENSP00000331500
MCPPVSMRYEEEGMSYLYASWMYQLQHGDQLSICFTCFKAAFLDFKDLLESEDWEEDNWDPELMEHTEAESEQEGSSGMELSWGQSPGQPVQGGSEAWGPGTLAAAPEGLEDAGLDPHFVPTELWPQEAVPLGLGLEDADWTQGLPWRFEELLTCSHWPSFFPS

SEQ ID NO: 87738 - protein, 1134 aa, Homo sapiens
  Payload ID: 17559
  Gene Symbol: TEX2
  Gene Name: testis expressed 2
  Uniprot ID: Q8IWB9
  ENSP ID: ENSP00000258991
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPAPVFLAPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 87739 - protein, 42 aa, Homo sapiens
  Payload ID: 17559
  Gene Symbol: TEX2
  Gene Name: testis expressed 2
  ENSP ID: ENSP00000462210
MTSLYGRHAEKTTDMPKPSAPKVHVQRSVSRDTIAIHFSASG

SEQ ID NO: 87740 - protein, 626 aa, Homo sapiens
  Payload ID: 17559
  Gene Symbol: TEX2
  Gene Name: testis expressed 2
  ENSP ID: ENSP00000462230
  MOD_RES (1)..(1): Any amino acid
XGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 87741 - protein, 1127 aa, Homo sapiens
  Payload ID: 17559
  Gene Symbol: TEX2
  Gene Name: testis expressed 2
  Uniprot ID: Q8IWB9
  ENSP ID: ENSP00000462665
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 87742 - protein, 1127 aa, Homo sapiens; identical to SEQ ID NO: 87741
  Payload ID: 17559
  Gene Symbol: TEX2
  Gene Name: testis expressed 2
  Uniprot ID: Q8IWB9
  ENSP ID: ENSP00000463001

SEQ ID NO: 87743 - protein, 52 aa, Homo sapiens
  Payload ID: 17559
  Gene Symbol: TEX2
  Gene Name: testis expressed 2
  ENSP ID: ENSP00000463286
MTSLYGRHAEKTTDMPKPSAPKVHVQRSVSRDTIAIHFSASGEEEEEEEEEF

SEQ ID NO: 87744 - protein, 1127 aa, Homo sapiens [sequence omitted]

SEQ ID NO: 87745 - protein, 150 aa, Homo sapiens
  Payload ID: 17560
  Gene Symbol: TEX22
  Gene Name: testis expressed 22
  Uniprot ID: C9J3V5
  ENSP ID: ENSP00000397002
MDSRKLSPRGKKLESHLSQEHRRPPLGLIAAWGQPSIQSSVQQGLQTQDWVCEPPERRRPGRRWSVSIDERRRLATLGGRERPGAAGTQLHCRDVVQMVAQLVSEDVDKDVLLPHPLRSTESTNAFQAFLARSAPFWHNATFEASRSPPS

SEQ ID NO: 87746 - protein, 63 aa, Homo sapiens
  Payload ID: 17560
  Gene Symbol: TEX22
  Gene Name: testis expressed 22
  ENSP ID: ENSP00000449736
MDSRKLSPRGKKLESHLSQEHRRPPLGLIAAWGQPSIQSSVQQGLQTQDWTTSTLRTPPATHT

SEQ ID NO: 87747 - protein, 289 aa, Homo sapiens
  Payload ID: 17561
  Gene Symbol: TEX26
  Gene Name: testis expressed 26
  Uniprot ID: Q8N6G2
  ENSP ID: ENSP00000369840
MEQPGPRAPDPSLCHHNLQPTDDPNWDSYATTMRTAFTPKTGAVPALIRQNGIRRLGYTYSLSDPILNQTQYSDEYTWKSHSKEDLIKTETSRGIKSHKSHLNEDIFLWTLPHCQQTGTLKNCLPWKIPASMKEVNKALSNQFISLTKRDFVDRSKAQKIKKSSHLSLEWKKLLPQPPDTEFRRNYQIPAKIPELQDFSFKYGCYSSLPVASQGLVPSVLHSYLRNQEHTKKQTTYQSDYDKTYPDFLMLLNSFTSSQVKEYLQSLSYKDRQIIDRFIRTHCDTNKKKK

SEQ ID NO: 87748 - protein, 61 aa, Homo sapiens
  Payload ID: 17561
  Gene Symbol: TEX26
  Gene Name: testis expressed 26
  ENSP ID: ENSP00000435263
PGPRAPDPSLCHHNLQPTDDPNWDSYATTMRTAFTPKTGAVPALIRTFSCGHYLTVNKRGH

SEQ ID NO: 87749 - protein, 196 aa, Homo sapiens
  Payload ID: 17562
  Gene Symbol: TEX261
  Gene Name: testis expressed 261
  Uniprot ID: Q6UWH6
  ENSP ID: ENSP00000272438
MWFMYLLSWLSLFIQVAFITLAVAAGLYYLAELIEEYTVATSRIIKYMIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGDDVVSNYFTKGKRGKRLGILVVFSFIKEAILPSRQKIY

SEQ ID NO: 87750 - protein, 51 aa, Homo sapiens
  Payload ID: 17562
  Gene Symbol: TEX261
  Gene Name: testis expressed 261
  ENSP ID: ENSP00000410335
MWFMYLLSWLSLFIQVAFITLAVAAGLYYLAELIEEYTVATSRIIKYMIWD

SEQ ID NO: 87751 - protein, 313 aa, Homo sapiens
  Payload ID: 17563
  Gene Symbol: TEX264
  Gene Name: testis expressed 264
  Uniprot ID: Q9Y6I9
  ENSP ID: ENSP00000340969
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 87752 - protein, 313 aa, Homo sapiens; identical to SEQ ID NO: 87751
  Payload ID: 17563
  Gene Symbol: TEX264
  Gene Name: testis expressed 264
  Uniprot ID: Q9Y6I9
  ENSP ID: ENSP00000378497

SEQ ID NO: 87753 - protein, 139 aa, Homo sapiens
  Payload ID: 17563
  Gene Symbol: TEX264
  Gene Name: testis expressed 264
  ENSP ID: ENSP00000393736
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYT

SEQ ID NO: 87754 - protein, 313 aa, Homo sapiens; identical to SEQ ID NO: 87751
  Payload ID: 17563
  Gene Symbol: TEX264
  Gene Name: testis expressed 264
  Uniprot ID: Q9Y6I9
  ENSP ID: ENSP00000396628

SEQ ID NO: 87755 - protein, 313 aa, Homo sapiens; identical to SEQ ID NO: 87751
  Payload ID: 17563
  Gene Symbol: TEX264
  Gene Name: testis expressed 264
  Uniprot ID: Q9Y6I9
  ENSP ID: ENSP00000398802

SEQ ID NO: 87756 - protein, 151 aa, Homo sapiens
  Payload ID: 17563
  Gene Symbol: TEX264
  Gene Name: testis expressed 264
  ENSP ID: ENSP00000405783
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRV

SEQ ID NO: 87757 - protein, 215 aa, Homo sapiens
  Payload ID: 17563
  Gene Symbol: TEX264
  Gene Name: testis expressed 264
  ENSP ID: ENSP00000407151
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDG

SEQ ID NO: 87758 - protein, 313 aa, Homo sapiens; identical to SEQ ID NO: 87751
  Payload ID: 17563
  Gene Symbol: TEX264
  Gene Name: testis expressed 264
  Uniprot ID: Q9Y6I9
  ENSP ID: ENSP00000408186

SEQ ID NO: 87759 - protein, 104 aa, Homo sapiens
  Payload ID: 17563
  Gene Symbol: TEX264
  Gene Name: testis expressed 264
  ENSP ID: ENSP00000408989
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGE

SEQ ID NO: 87760 - protein, 216 aa, Homo sapiens
  Payload ID: 17563
  Gene Symbol: TEX264
  Gene Name: testis expressed 264
  ENSP ID: ENSP00000415957
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGT

SEQ ID NO: 87761 - protein, 313 aa, Homo sapiens; identical to SEQ ID NO: 87751
  Payload ID: 17563
  Gene Symbol: TEX264
  Gene Name: testis expressed 264
  Uniprot ID: Q9Y6I9
  ENSP ID: ENSP00000477946

SEQ ID NO: 87762 - protein, 239 aa, Homo sapiens
  Payload ID: 17563
  Gene Symbol: TEX264
  Gene Name: testis expressed 264
  ENSP ID: ENSP00000478139
MSDLLLLGLIGGLTLLLLLTLLAFAGYSGLLAGVEVSAGSPPIRNVTVAYKFHMGLYGETGRLFTESCSISPKLRSIAVYYDNPHMERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 87763 - protein, 410 aa, Homo sapiens
  Payload ID: 17564
  Gene Symbol: TEX28
  Gene Name: testis expressed 28
  Uniprot ID: O15482
  ENSP ID: ENSP00000478834
MVLKAEHTRSPSATLPSNVPSCRSLSSSEDGPSGPSSLADGGLAHNLQDSVRHRILYLSEQLRVEKASRDGNTVSYLKLVSKADRHQVPHIQQAFEKVNQRASATIAQIEHRLHQCHQQLQELEEGCRPEGLLLMAESDPANCEPPSEKALLSEPPEPGGEDGPVNLPHASRPFILESRFQSLQQGTCLETEDVAQQQNLLLQKVKAELEEAKRFHISLQESYHSLKERSLTDLQLLLESLQEEKCRQALMEEQVNGRLQGQLNEIYNLKHNLACSEERMAYLSYERAKEIWEITETFKSRISKLEMLQQVTQLEAAEHLQSRPPQMLFKFLSPRLSLATVLLVFVSTLCACPSSLISSRLCTCTMLMLIGLGVLAWQRWRAIPATDWQEWVPSRCRLYSKDSGPPADGP

SEQ ID NO: 87764 - protein, 410 aa, Homo sapiens; identical to SEQ ID NO: 87763
  Payload ID: 17564
  Gene Symbol: TEX28
  Gene Name: testis expressed 28
  Uniprot ID: O15482
  ENSP ID: ENSP00000479148

SEQ ID NO: 87765 - protein, 410 aa, Homo sapiens; identical to SEQ ID NO: 87763
  Payload ID: 17564
  Gene Symbol: TEX28
  Gene Name: testis expressed 28
  Uniprot ID: O15482
  ENSP ID: ENSP00000482010

SEQ ID NO: 87766 - protein, 151 aa, Homo sapiens
  Payload ID: 17565
  Gene Symbol: TEX29
  Gene Name: testis expressed 29
  Uniprot ID: Q8N6K0
  ENSP ID: ENSP00000283547
MEYVLEVKNSPRHLLKQFTVCDVPLYDICDYNVSRDRCQELGCCFYEGVCYKKAVPIYIHVFSALIVIIAGAFVITIIYRVIQESRKEKAIPVDVALPQKSSEKAELASSSSKLGLKPASPGPPSAGPSMKSDEDKDDVTGTITEAEETED

SEQ ID NO: 87767 - protein, 84 aa, Homo sapiens
  Payload ID: 17565
  Gene Symbol: TEX29
  Gene Name: testis expressed 29
  ENSP ID: ENSP00000431661
MPAICQGRQEVTVQAQCARPLHLSAAAMEYVLEVKNSPRHLLKQFTVCDVPLYDICDYNVSRDRCQELGCCFYEGVCYKKAVPI

SEQ ID NO: 87768 - protein, 186 aa, Homo sapiens
  Payload ID: 17566
  Gene Symbol: TEX30
  Gene Name: testis expressed 30
  ENSP ID: ENSP00000365187
MNLPHLMSLASHLASHGFFCLRFTCKGLNIVHRIKAYKSVLNYLKTSGEYKLAGVFLGGRSMGSRAAASVMCHIEPDDGDDFVRGLICISYPLHHPKQQHKLRDEDLFRLKEPVLFVSGSADEMCEKNLLEKVAQKMQAPHKIHWIEKANHSMAVKGRSTNDVFKEINTQILFWIQEITEMDKKCH

SEQ ID NO: 87769 - protein, 186 aa, Homo sapiens; identical to SEQ ID NO: 87768
  Payload ID: 17566
  Gene Symbol: TEX30
  Gene Name: testis expressed 30
  ENSP ID: ENSP00000365189

SEQ ID NO: 87770 - protein, 72 aa, Homo sapiens
  Payload ID: 17566
  Gene Symbol: TEX30
  Gene Name: testis expressed 30
  ENSP ID: ENSP00000365190
MNLPHLMSLASHLASHGFFCLRFTCKGLNIVHRIKAYKSVLNYLKTSGEYKLAGVFLGELVGESGTENASSP

SEQ ID NO: 87771 - protein, 113 aa, Homo sapiens
  Payload ID: 17566
  Gene Symbol: TEX30
  Gene Name: testis expressed 30
  Uniprot ID: Q5JUR7
  ENSP ID: ENSP00000365195
MSHTEVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGELVGESGTENASSP

SEQ ID NO: 87772 - protein, 113 aa, Homo sapiens; identical to SEQ ID NO: 87771
  Payload ID: 17566
  Gene Symbol: TEX30
  Gene Name: testis expressed 30
  Uniprot ID: Q5JUR7
  ENSP ID: ENSP00000365197

SEQ ID NO: 87773 - protein, 227 aa, Homo sapiens
  Payload ID: 17566
  Gene Symbol: TEX30
  Gene Name: testis expressed 30
  Uniprot ID: Q5JUR7
  ENSP ID: ENSP00000365200
MSHTEVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGGRSMGSRAAASVMCHIEPDDGDDFVRGLICISYPLHHPKQQHKLRDEDLFRLKEPVLFVSGSADEMCEKNLLEKVAQKMQAPHKIHWIEKANHSMAVKGRSTNDVFKEINTQILFWIQEITEMDKKCH

SEQ ID NO: 87774 - protein, 280 aa, Homo sapiens
  Payload ID: 17567
  Gene Symbol: TEX33
  Gene Name: testis expressed 33
  Uniprot ID: O43247
  ENSP ID: ENSP00000371243
MELGHGAGTTTFTRAHLNDKEGQQDLDPWKAAYSSLDTSKFKNQGLSSPQPLPLGASAQGSSLGQCHLKEIPPPPPTAASRDSLGMDPQSRSLKNAGSRSSSRENRATSGEGAQPCQGTDDGPSLGAQDQRSTPTNQKGSIIPNNIRHKFGSNVVDQLVSEEQAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 87775 - protein, 195 aa, Homo sapiens
  Payload ID: 17567
  Gene Symbol: TEX33
  Gene Name: testis expressed 33
  Uniprot ID: O43247
  ENSP ID: ENSP00000385179
MDPQSRSLKNAGSRSSSRENRATSGEGAQPCQGTDDGPSLGAQDQRSTPTNQKGSIIPNNIRHKFGSNVVDQLVSEEQAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 87776 - protein, 280 aa, Homo sapiens; identical to SEQ ID NO: 87774
  Payload ID: 17567
  Gene Symbol: TEX33
  Gene Name: testis expressed 33
  Uniprot ID: O43247
  ENSP ID: ENSP00000386118

SEQ ID NO: 87777 - protein, 139 aa, Homo sapiens
  Payload ID: 17567
  Gene Symbol: TEX33
  Gene Name: testis expressed 33
  ENSP ID: ENSP00000406640
  MOD_RES (1)..(1): Any amino acid
XRTWTPGKRPTVPWTPPSSRTRAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 87778 - protein, 233 aa, Homo sapiens
  Payload ID: 17568
  Gene Symbol: TEX35
  Gene Name: testis expressed 35
  Uniprot ID: Q5T0J7
  ENSP ID: ENSP00000323795
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGNIPSEASGLYKGGEEPVTTQPSVGHAVPAPKSQTEGR

SEQ ID NO: 87779 - protein, 215 aa, Homo sapiens
  Payload ID: 17568
  Gene Symbol: TEX35
  Gene Name: testis expressed 35
  Uniprot ID: Q5T0J7
  ENSP ID: ENSP00000356611
MSAKRAELKKTHLVKERHCWTSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGIYAAVGLLDLW

SEQ ID NO: 87780 - protein, 201 aa, Homo sapiens
  Payload ID: 17568
  Gene Symbol: TEX35
  Gene Name: testis expressed 35
  Uniprot ID: Q5T0J7
  ENSP ID: ENSP00000356613
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCVSETLPEPSTGARPLAPAPW

SEQ ID NO: 87781 - protein, 99 aa, Homo sapiens
  Payload ID: 17568
  Gene Symbol: TEX35
  Gene Name: testis expressed 35
  ENSP ID: ENSP00000356614
MSAKRAELKKTHLSKNYKAVCLELKPEPTKVRSPFEAMQAARPEIHGEVTRSQGSFADPSGQDLSQTFDYKAVKQEGRFTKAGRTPRLLEELSLLLLPL

SEQ ID NO: 87782 - protein, 212 aa, Homo sapiens
  Payload ID: 17568
  Gene Symbol: TEX35
  Gene Name: testis expressed 35
  Uniprot ID: Q5T0J7
  ENSP ID: ENSP00000356615
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRAQLQNLPAVPIHHLQAP

SEQ ID NO: 87783 - protein, 50 aa, Homo sapiens
  Payload ID: 17568
  Gene Symbol: TEX35
  Gene Name: testis expressed 35
  ENSP ID: ENSP00000413991
KTGLTGSPSSLWDLLREMFVVCSKEQLQSGGKYSHQVWAPFSPLASGAAF

SEQ ID NO: 87784 - protein, 88 aa, Homo sapiens
  Payload ID: 17568
  Gene Symbol: TEX35
  Gene Name: testis expressed 35
  ENSP ID: ENSP00000430720
MSAKRAELKKTHLSKNYKAVCLELKPEPTKTFDYKAVKQEGRFTKAGVTQDLKNELREVREELKEKMEEIKQPCLSSLLDKGSNGQGF

SEQ ID NO: 87785 - protein, 186 aa, Homo sapiens
  Payload ID: 17569
  Gene Symbol: TEX36
  Gene Name: testis expressed 36
  Uniprot ID: Q5VZQ5
  ENSP ID: ENSP00000357811
MTKGRRFNPPSDKDGRWFPHIGLTQKTPESITSATSKEPQSPHLPRQAEGKLPPIYKVREKQAVNNQFPFSVHDNRHSLENSGCYLDSGLGRKKISPDKRQHVSRNFNLWACDYVPSCLDGFSNNQISYVYKEAMVVSSFRRFPRCYKEIWNAFTFLPERSYTEVLKKKPKVRFTVDKKVVSSLES

SEQ ID NO: 87786 - protein, 129 aa, Homo sapiens
  Payload ID: 17569
  Gene Symbol: TEX36
  Gene Name: testis expressed 36
  ENSP ID: ENSP00000431764
MTKGRRFNPPSDKDGRWFPHIGLTQKTPESITSATSKEPQSPHLPRQAEGKLPPIYKVREKQAVNNQFPFSVHDNRHSLENSGCYLDSERMTATDPQGEPDKRQEFYEPVRTQSIPHPGLRTNAPLLAV

SEQ ID NO: 87787 - protein, 99 aa, Homo sapiens
  Payload ID: 17569
  Gene Symbol: TEX36
  Gene Name: testis expressed 36
  ENSP ID: ENSP00000434299
MTKGRRFNPPSDKDGRWFPHIGLTQKTPESITSATSKEPQSPHLPRQAEGKLPPIYKVREKQAVNNQFPFSVHDNRHSLENSGCYLDSFADGLSWDFSL

SEQ ID NO: 87788 - protein, 180 aa, Homo sapiens
  Payload ID: 17570
  Gene Symbol: TEX37
  Gene Name: testis expressed 37
  Uniprot ID: Q96LM6
  ENSP ID: ENSP00000307142
MAGVKYPGQDPVDLDIYQSSHMVDYQPYRKHKYSRVTPQEQAKLDAQLRDKEFYRPIPNPNPKLTDGYPAFKRPHMTAKDLGLPGFFPSQEHEATREDERKFTSTCHFTYPASHDLHLAQGDPNQVLQSADFPCLVDPKHQPAAEMAKGYLLLPGCPCLHCHIVKVPILNRWGPLMPFYQ

SEQ ID NO: 87789 - protein, 206 aa, Homo sapiens
  Payload ID: 17571
  Gene Symbol: TEX38
  Gene Name: testis expressed 38
  Uniprot ID: Q6PEX7
  ENSP ID: ENSP00000455854
MDSQQEDLRFPGMWVSLYFGILGLCSVITGGCIIFLHWRKNLRREEHAQQWVEVMRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 87790 - protein, 152 aa, Homo sapiens
  Payload ID: 17571
  Gene Symbol: TEX38
  Gene Name: testis expressed 38
  ENSP ID: ENSP00000456524
MRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 87791 - protein, 130 aa, Homo sapiens
  Payload ID: 17571
  Gene Symbol: TEX38
  Gene Name: testis expressed 38
  ENSP ID: ENSP00000456892
MNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 87792 - protein, 139 aa, Homo sapiens
  Payload ID: 17571
  Gene Symbol: TEX38
  Gene Name: testis expressed 38
  ENSP ID: ENSP00000457220
MWLPPHHLRAQFTLWVSLYFGILGLCSVITGGCIIFLHWRKNLRREEHAQQWVEVMRAATFTYSPLLYWINKRRRYGMNAAINTGPAPAVTKTETEVQNPDVLWDLDIPEGRSHADQDSNPKAEAPAPLQPALQLAPQQ

SEQ ID NO: 87793 - protein, 158 aa, Homo sapiens
  Payload ID: 17572
  Gene Symbol: TEX40
  Gene Name: testis expressed 40
  ENSP ID: ENSP00000443917
MPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 87794 - protein, 134 aa, Homo sapiens
  Payload ID: 17573
  Gene Symbol: TEX43
  Gene Name: testis expressed 43
  Uniprot ID: Q6ZNM6
  ENSP ID: ENSP00000349669
MASGKDTCPTLPKLTNNCSDESLYKSANKYEEIHLPRFSLKQGMIPRRYVMPWKENMIFRNVNLKQAEVCGIHTGPLEDSLFLNHSERLCHGEDRKVVFQKGPPEIKIADMPLHSPLSRYQSTVISHGFRRRLV

SEQ ID NO: 87795 - protein, 391 aa, Homo sapiens
  Payload ID: 17574
  Gene Symbol: TEX9
  Gene Name: testis expressed 9
  Uniprot ID: Q8N6V9
  ENSP ID: ENSP00000342169
MAGRSLCLTRSSVPGTPFPPPVQQPSTPGPDLLALEEEYKRLNAELQAKTADVVQQAKEIIRDRQEVRSRPVSTQMKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERELENKRRLQKQAASSQSATEVRLNRALEEAEKYKLELSKLRQNNKDIANEEHKKIEVLKSENKKLEKQKGELMIGFKKQLKLIDVLKRQKMHIEAAKMLSFTEEEFMKALEWGNS

SEQ ID NO: 87796 - protein, 316 aa, Homo sapiens
  Payload ID: 17574
  Gene Symbol: TEX9
  Gene Name: testis expressed 9
  Uniprot ID: Q8N6V9
  ENSP ID: ENSP00000438745
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERELENKRRLQKQAASSQSATEVRLNRALEEAEKYKLELSKLRQNNKDIANEEHKKIEVLKSENKKLEKQKGELMIGFKKQLKLIDVLKRQKMHIEAAKMLSFTEEEFMKALEWGNS

SEQ ID NO: 87797 - protein, 104 aa, Homo sapiens
  Payload ID: 17574
  Gene Symbol: TEX9
  Gene Name: testis expressed 9
  ENSP ID: ENSP00000452791
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDD

SEQ ID NO: 87798 - protein, 208 aa, Homo sapiens
  Payload ID: 17574
  Gene Symbol: TEX9
  Gene Name: testis expressed 9
  ENSP ID: ENSP00000453398
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERVIIWYFS

SEQ ID NO: 87799 - protein, 79 aa, Homo sapiens
  Payload ID: 17574
  Gene Symbol: TEX9
  Gene Name: testis expressed 9
  ENSP ID: ENSP00000453431
MAGRSLCLTVSSTPGSWGASGFRRLGRLTSFNFGSESLWLFYREAAFQGLRSRHPFSNPLHLDPTSSPWRKNISKKFGG

SEQ ID NO: 87800 - protein, 102 aa, Homo sapiens
  Payload ID: 17574
  Gene Symbol: TEX9
  Gene Name: testis expressed 9
  ENSP ID: ENSP00000453960
MQQSQVEKYKTLFEEANKKYDGLQQQLSSVERELENKRRLQKQAASSQSATEVRLNRALEEAEKYKLELSKLRQNNKMHIEAAKMLSFTEEEFMKALEWGNS

SEQ ID NO: 87801 - protein, 283 aa, Homo sapiens
  Payload ID: 17574
  Gene Symbol: TEX9
  Gene Name: testis expressed 9
  ENSP ID: ENSP00000456593
MAGRSLCLTRSSVPGTPFPPPVQQPSTPGPDLLALEEEYKRLNAELQAKTADVVQQAKEIIRDRQEVRSRPVSTQMKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERVIIWYFS

SEQ ID NO: 87802 - protein, 294 aa, Homo sapiens
  Payload ID: 17575
  Gene Symbol: TSPY1
  Gene Name: testis specific protein, Y-linked 1
  Uniprot ID: Q01534
  ENSP ID: ENSP00000389324
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESAPEELLAVQVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITEYRASHSTPIEWYPDYEVEAYRRRHHNSSLNFFNWFSDHNFAGSNKIAESPDRSYVRTCGAIPCNTTRG

SEQ ID NO: 87803 - protein, 308 aa, Homo sapiens
  Payload ID: 17575
  Gene Symbol: TSPY1
  Gene Name: testis specific protein, Y-linked 1
  Uniprot ID: Q01534
  ENSP ID: ENSP00000403304
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESAPEELLAVQVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87804 - protein, 221 aa, Homo sapiens
  Payload ID: 17575
  Gene Symbol: TSPY1
  Gene Name: testis specific protein, Y-linked 1
  ENSP ID: ENSP00000406010
MRPEGSLTYRVPERLRQGFCGVGRAAQALVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87805 - protein, 308 aa, Homo sapiens
  Payload ID: 17575
  Gene Symbol: TSPY1
  Gene Name: testis specific protein, Y-linked 1
  ENSP ID: ENSP00000473286
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESAPEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87806 - protein, 294 aa, Homo sapiens
  Payload ID: 17576
  Gene Symbol: TSPY10
  Gene Name: testis specific protein, Y-linked 10
  ENSP ID: ENSP00000397151
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAESPDRSYVRTCGAIPCNTTRG

SEQ ID NO: 87807 - protein, 308 aa, Homo sapiens
  Payload ID: 17576
  Gene Symbol: TSPY10
  Gene Name: testis specific protein, Y-linked 10
  ENSP ID: ENSP00000406407
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87808 - protein, 308 aa, Homo sapiens
  Payload ID: 17577
  Gene Symbol: TSPY2
  Gene Name: testis specific protein, Y-linked 2
  Uniprot ID: A6NKD2
  ENSP ID: ENSP00000314077
MRPEGSLTYRVPERLRQGSCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHRVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87809 - protein, 294 aa, Homo sapiens
  Payload ID: 17577
  Gene Symbol: TSPY2
  Gene Name: testis specific protein, Y-linked 2
  ENSP ID: ENSP00000372512
MRPEGSLTYRVPERLRQGSCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHRVHLCKIMLFFRSNPYFQNKVITKEYLVNITEYRASHSTPIEWYPDYEVEAYRRRHHNSSLNFFNWFSDHNFAGSNKIAESPDRSYVRTCGAIPCNTTRG

SEQ ID NO: 87810 - protein, 221 aa, Homo sapiens
  Payload ID: 17577
  Gene Symbol: TSPY2
  Gene Name: testis specific protein, Y-linked 2
  ENSP ID: ENSP00000414049
MRPEGSLTYRVPERLRQGSCGVGRAAQALVELEPVNAQARKAFSRQREKMERRRKPHLDRRGAVIQSVPGFWANVIANHPQMSALITDEDEDMLSYMVSLEVEEEKHRVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87811 - protein, 308 aa, Homo sapiens; identical to SEQ ID NO: 87807
  Payload ID: 17578
  Gene Symbol: TSPY3
  Gene Name: testis specific protein, Y-linked 3
  Uniprot ID: P0CV98
  ENSP ID: ENSP00000398163

SEQ ID NO: 87812 - protein, 294 aa, Homo sapiens; identical to SEQ ID NO: 87806
  Payload ID: 17578
  Gene Symbol: TSPY3
  Gene Name: testis specific protein, Y-linked 3
  ENSP ID: ENSP00000412988

SEQ ID NO: 87813 - protein, 300 aa, Homo sapiens
  Payload ID: 17579
  Gene Symbol: TSPY4
  Gene Name: testis specific protein, Y-linked 4
  ENSP ID: ENSP00000372471
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAESPDRSYVRTCGAIPCNTTRG

SEQ ID NO: 87814 - protein, 314 aa, Homo sapiens
  Payload ID: 17579
  Gene Symbol: TSPY4
  Gene Name: testis specific protein, Y-linked 4
  Uniprot ID: P0CV99
  ENSP ID: ENSP00000399668
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87815 - protein, 308 aa, Homo sapiens
  Payload ID: 17580
  Gene Symbol: TSPY8
  Gene Name: testis specific protein, Y-linked 8
  Uniprot ID: P0CW00
  ENSP ID: ENSP00000287721
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYLDYEVEAYRRRHHNSSLNFFNWFSDHNFAGSNKIAEILCKDLWRNPLQYYKRMKPPEEGTETSGDSQLLS

SEQ ID NO: 87816 - protein, 294 aa, Homo sapiens
  Payload ID: 17580
  Gene Symbol: TSPY8
  Gene Name: testis specific protein, Y-linked 8
  ENSP ID: ENSP00000372462
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYLDYEVEAYRRRHHNSSLNFFNWFSDHNFAGSNKIAESPDRSYVRTCGAIPCNTTRG

SEQ ID NO: 87817 - protein, 308 aa, Homo sapiens
  Payload ID: 17580
  Gene Name: testis specific protein, Y-linked 8
  ENSP ID: ENSP00000372467
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87818 - protein, 314 aa, Homo sapiens
  Payload ID: 17581
  Gene Name: testis specific protein, Y-linked 9, pseudogene
  ENSP ID: ENSP00000473619
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPQLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 87819 - protein, 698 aa, Homo sapiens
  Payload ID: 17582
  Gene Name: testis specific, 10
  Uniprot ID: Q9BZW7
  ENSP ID: ENSP00000347161
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 87820 - protein, 690 aa, Homo sapiens
  Payload ID: 17582
  Gene Name: testis specific, 10
  ENSP ID: ENSP00000377122
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLE

SEQ ID NO: 87821 - protein, 698 aa, Homo sapiens; identical to SEQ ID NO: 87819
  Payload ID: 17582
  Gene Name: testis specific, 10
  Uniprot ID: Q9BZW7
  ENSP ID: ENSP00000377123

SEQ ID NO: 87822 - protein, 620 aa, Homo sapiens
  Payload ID: 17582
  Gene Name: testis specific, 10
  ENSP ID: ENSP00000386508
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLE

SEQ ID NO: 87823 - protein, 698 aa, Homo sapiens; identical to SEQ ID NO: 87819
  Payload ID: 17582
  Gene Name: testis specific, 10
  Uniprot ID: Q9BZW7
  ENSP ID: ENSP00000386956

SEQ ID NO: 87824 - protein, 403 aa, Homo sapiens
  Payload ID: 17583
  Gene Name: testis specific, 10 interacting protein
  Uniprot ID: Q3SY00
  ENSP ID: ENSP00000477317
MGQDTDMLNTYQQLVRTPSVRPGQDVRLQAPGTRTGLLKLLSTVSQDKQGCLGSGDGVPNQDLQQRSQSSRQTAKKDRKPRGQSKKGQGSEESEDHFPLLPRKPSFPFQWAWESIATDVRAVLQPSSPTPGHQALPMPSSFSQRQSRRKSTANLPEAHGCCWKTEAQNLKARQQLGAWGGVSIPTGKGELGSEPPSGLQLPGRRPGSGSASDKQVQLQSLGAEEAERGLSSGVLPQRPRRGSISEEEQFSEATEEAEEGEHRTPCRRRAGCQRKGQISGEEASDEGEVQGQSQGSSPSFNNLRRRQWRKTRAKELQGPWDLEKLHRQLQRDLDCGSHQEPAAGLGAAAAGGAAAGRAAAGPDTACTAAGGPLPGSLRTQREPGPWGGPAQAGGAEAPGATALC

SEQ ID NO: 87825 - protein, 114 aa, Homo sapiens
  Payload ID: 17583
  Gene Name: testis specific, 10 interacting protein
  ENSP ID: ENSP00000482640
MGQDTDMLNTYQQLVRTPSVRPGQDVRLQAPGTRTGLLKLLSTVSQDKQEPAAGLGAAAAGGAAAGRAAAGPDTACTAAGGPLPGSLRTQREPGPWGGPAQAGGAEAPGATALC

SEQ ID NO: 87826 - protein, 49 aa, Homo sapiens
  Payload ID: 17583
  Gene Name: testis specific, 10 interacting protein
  ENSP ID: ENSP00000483400
DMLNTYQQLVRTPSVRPGQDVRLQAPGTRTGLLKLLSTVSQDKQVREAQ

SEQ ID NO: 87827 - protein, 556 aa, Homo sapiens
  Payload ID: 17583
  Gene Name: testis specific, 10 interacting protein
  Uniprot ID: Q3SY00
  ENSP ID: ENSP00000484252
MGQDTDMLNTYQQLVRTPSVRPGQDVRLQAPGTRTGLLKLLSTVSQDKQGCLGSGDGVPNQDLQQRSQSSRQTAKKDRKPRGQSKKGQGSEESEDHFPLLPRKPSFPFQWAWESIATDVRAVLQPSSPTPGHQALPMPSSFSQRQSRRKSTANLPEAHGCCWKTEAQNLKARQQLGAWGGVSIPTGKGELGSEPPSGLQLPGRRPGSGSASDKQVQLQSLGAEEAERGLSSGVLPQRPRRGSISEEEQFSEATEEAEEGEHRTPCRRRAGCQRKGQISGEEASDEGEVQGQSQGSSPSFNNLRRRQWRKTRAKELQGPWDLEKLHRQLQRDLDCGPQKLPWKTLRAAFQASKRNGKAYASGYDETFVSANLPNRTFHKRQEATRSLLQAWERQRQEERQQAELRRARTQHVQRQVAHCLAAYAPRGSRGPGAAQRKLEELRRQERQRFAEYQAELQGIQHRVQARPFLFQQAMQANARLTVTRRFSQVLSALGLDEEQLLSEAGKVDREGTPRKPRSHRSMGVRMEHSPQRPPRTEPTGSQPDRHYNPSLDPECSP

SEQ ID NO: 87828 - protein, 275 aa, Homo sapiens
  Payload ID: 17584
  Gene Name: testis specific, 13
  Uniprot ID: Q96PP4
  ENSP ID: ENSP00000348996
MSQKRQTKFQNGKSKTSENSSAKREKGMVVNSKEISDAVGQSKFVLENLRHYTVHPNLAQYYKPLKATALQKFLAQNRKNTSFMLKVTQYDQDKTLLIMTNNPPPCSITQQDKESASKYFSKELLLKVMESHHQHKPTENLWLPRMPQKKKLRSKLKPIFPLILSDDPTSKREQWFRFSTDNDFKSEGKYSKVYALRTQKKMYPQLTFAPVHERDMRKDASKKSASERPISKVIREPLTLASLLEDMPTRTAPGESAFRNGRAPQWIIKKATVIG

SEQ ID NO: 87829 - protein, 275 aa, Homo sapiens; identical to SEQ ID NO: 87828
  Payload ID: 17584
  Gene Name: testis specific, 13
  Uniprot ID: Q96PP4
  ENSP ID: ENSP00000406047

SEQ ID NO: 87830 - protein, 58 aa, Homo sapiens
  Payload ID: 17584
  Gene Name: testis specific, 13
  ENSP ID: ENSP00000407352
MSQKRQTKFQNGKSKTSENSSAKREKGMVVNSKEISDAVGQSKFVLENLRHYTVHPNL

SEQ ID NO: 87831 - protein, 76 aa, Homo sapiens
  Payload ID: 17584
  Gene Name: testis specific, 13
  ENSP ID: ENSP00000415856
MSQKRQTKFQNGKSKTSENSSAKREKGMVVNSKEISDAVGQSKFVLENLRHYTVHPNLAQYYKPLKATALQKFLAQ

SEQ ID NO: 87832 - protein, 298 aa, Homo sapiens
  Payload ID: 17585
  Gene Name: testis, prostate and placenta expressed
  Uniprot ID: Q6URK8
  ENSP ID: ENSP00000290871
MGIVCAQCSFILLLSIIRARPPPFLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRQEALCGAWAGRPCSPDSPRPYPCCPPQYCLSQNPSLDRYGQKPLPFDSLNTFRSFGSSYSRVNYLTPWH

SEQ ID NO: 87833 - protein, 271 aa, Homo sapiens
  Payload ID: 17585
  Gene Name: testis, prostate and placenta expressed
  Uniprot ID: Q6URK8
  ENSP ID: ENSP00000401917
MGIVCAQCSFILLLSIIRARPPPFLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRYCLSQNPSLDRYGQKPLPFDSLNTFRSFGSSYSRVNYLTPWH

SEQ ID NO: 87834 - protein, 626 aa, Homo sapiens
  Payload ID: 17586
  Gene Name: testis-specific kinase 1
  Uniprot ID: Q15569
  ENSP ID: ENSP00000338127
MAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 87835 - protein, 626 aa, Homo sapiens; identical to SEQ ID NO: 87834
  Payload ID: 17586
  Gene Name: testis-specific kinase 1
  Uniprot ID: Q15569
  ENSP ID: ENSP00000481045

SEQ ID NO: 87836 - protein, 542 aa, Homo sapiens
  Payload ID: 17587
  Gene Name: testis-specific kinase 2
  Uniprot ID: Q96S53
  ENSP ID: ENSP00000361156
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTEMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 87837 - protein, 571 aa, Homo sapiens
  Payload ID: 17587
  Gene Name: testis-specific kinase 2
  Uniprot ID: Q96S53
  ENSP ID: ENSP00000361158
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 87838 - protein, 367 aa, Homo sapiens
  Payload ID: 17588
  Gene Name: testis-specific serine kinase 1B
  Uniprot ID: Q9BXA7
  ENSP ID: ENSP00000375081
MDDAAVLKRRGYLLGINLGEGSYAKVKSAYSERLKFNVAIKIIDRKKAPADFLEKFLPREIEILAMLNHCSIIKTYEIFETSHGKVYIVMELAVQGDLLELIKTRGALHEDEARKKFHQLSLAIKYCHDLDVVHRDLKCDNLLLDKDFNIKLSDFSFSKRCLRDDSGRMALSKTFCGSPAYAAPEVLQGIPYQPKVYDIWSLGVILYIMVCGSMPYDDSNIKKMLRIQKEHRVNFPRSKHLTGECKDLIYHMLQPDVNRRLHIDEILSHCWMQPKARGSPSVAINKEGESSRGTEPLWTPEPGSDKKSATKLEPEGEAQPQAQPETKPEGTAMQMSRQSEILGFPSKPSTMETEEGPPQQPPETRAQ

SEQ ID NO: 87839 - protein, 358 aa, Homo sapiens
  Payload ID: 17589
  Gene Name: testis-specific serine kinase 2
  Uniprot ID: Q96PF2
  ENSP ID: ENSP00000382544
MDDATVLRKKGYIVGINLGKGSYAKVKSAYSERLKFNVAVKIIDRKKTPTDFVERFLPREMDILATVNHGSIIKTYEIFETSDGRIYIIMELGVQGDLLEFIKCQGALHEDVARKMFRQLSSAVKYCHDLDIVHRDLKCENLLLDKDFNIKLSDFGFSKRCLRDSNGRIILSKTFCGSAAYAAPEVLQSIPYQPKVYDIWSLGVILYIMVCGSMPYDDSDIRKMLRIQKEHRVDFPRSKNLTCECKDLIYRMLQPDVSQRLHIDEILSHSWLQPPKPKATSSASFKREGEGKYRAECKLDTKTGLRPDHRPDHKLGAKTQHRLLVVPENENRMEDRLAETSRAKDHHISGAEVGKAST

SEQ ID NO: 87840 - protein, 268 aa, Homo sapiens
  Payload ID: 17590
  Gene Name: testis-specific serine kinase 3
  Uniprot ID: Q96PN8
  ENSP ID: ENSP00000362634
MEDFLLSNGYQLGKTIGEGTYSKVKEAFSKKHQRKVAIKVIDKMGGPEEFIQRFLPRELQIVRTLDHKNIIQVYEMLESADGKICLVMELAEGGDVFDCVLNGGPLPESRAKALFRQMVEAIRYCHGCGVAHRDLKCENALLQGFNLKLTDFGFAKVLPKSHRELSQTFCGSTAYAAPEVLQGIPHDSKKGDVWSMGVVLYVMLCASLPFDDTDIPKMLWQQQKGVSFPTHLSISADCQDLLKRLLEPDMILRPSIEEVSWHPWLAST

SEQ ID NO: 87841 - protein, 35 aa, Homo sapiens
  Payload ID: 17590
  Gene Name: testis-specific serine kinase 3
  ENSP ID: ENSP00000459187
MLESADGKICLVMELAEGGDVFDCVLNGGPLPESR

SEQ ID NO: 87842 - protein, 328 aa, Homo sapiens
  Payload ID: 17591
  Gene Name: testis-specific serine kinase 4
  Uniprot ID: Q6SA08
  ENSP ID: ENSP00000287913
MGKGDVLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 87843 - protein, 338 aa, Homo sapiens
  Payload ID: 17591
  Gene Name: testis-specific serine kinase 4
  Uniprot ID: Q6SA08
  ENSP ID: ENSP00000339179
MGKGDVLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRLMPSLSAAGRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 87844 - protein, 135 aa, Homo sapiens
  Payload ID: 17591
  Gene Name: testis-specific serine kinase 4
  ENSP ID: ENSP00000412180
MGKGDVLEAAPTTTAYHSLMDEYGYEVGKAIGHGSYGSVYEAFYTKQKVMVAVKIISKKKASDDYLNKFLPREIQNLILQMLRQATKRATILDIIKDSWVLKFQPEQPTHEIRLLEAMCQLHNTTKQHQSLQITT

SEQ ID NO: 87845 - protein, 108 aa, Homo sapiens
  Payload ID: 17591
  Gene Name: testis-specific serine kinase 4
  ENSP ID: ENSP00000450752
  MOD_RES (1)..(1): Any amino acid
XYRQVNCFSHLSQTYCGSFAYACPEILRGLPYNPFLSDTWSMGVILYTLVVAHLPFDDTNLKKLLRETQKEVTFPANHTISQECKVQLLIACVAQWRKTQARPLSPLL

SEQ ID NO: 87846 - protein, 143 aa, Homo sapiens
  Payload ID: 17591
  Gene Name: testis-specific serine kinase 4
  ENSP ID: ENSP00000451121
  MOD_RES (1)..(1): Any amino acid
XLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRT

SEQ ID NO: 87847 - protein, 252 aa, Homo sapiens
  Payload ID: 17591
  Gene Name: testis-specific serine kinase 4
  Uniprot ID: Q6SA08
  ENSP ID: ENSP00000452054
MKVLRHKYLINFYRAIESTSRVYIILELAQGGDVLEWIQRYGACSEPLAGKWFSQLTLGIAYLHSKSIVHRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 87848 - protein, 273 aa, Homo sapiens
  Payload ID: 17592
  Gene Name: testis-specific serine kinase 6
  Uniprot ID: Q9BXA6
  ENSP ID: ENSP00000466056
MSGDKLLSELGYKLGRTIGEGSYSKVKVATSKKYKGTVAIKVVDRRRAPPDFVNKFLPRELSILRGVRHPHIVHVFEFIEVCNGKLYIVMEAAATDLLQAVQRNGRIPGVQARDLFAQIAGAVRYLHDHHLVHRDLKCENVLLSPDERRVKLTDFGFGRQAHGYPDLSTTYCGSAAYASPEVLLGIPYDPKKYDVWSMGVVLYVMVTGCMPFDDSDIAGLPRRQKRGVLYPEGLELSERCKALIAELLQFSPSARPSAGQVARNCWLRAGDSG

SEQ ID NO: 87849 - protein, 273 aa, Homo sapiens; identical to SEQ ID NO: 87848
  Payload ID: 17592
  Gene Name: testis-specific serine kinase 6
  Uniprot ID: Q9BXA6
  ENSP ID: ENSP00000466477

SEQ ID NO: 87850 - protein, 109 aa, Homo sapiens
  Payload ID: 17592
  Gene Name: testis-specific serine kinase 6
  ENSP ID: ENSP00000473413
PDLSTTYCGSAAYASPEVLLGIPYDPKKYDVWSMGVVLYVMVTGCMPFDDSDIAGLPRRQKRGVLYPEGLELSERCKALIAELLQFSPSARPSAGQVARNCWLRAGDSG

SEQ ID NO: 87851 - protein, 592 aa, Homo sapiens
  Payload ID: 17593
  Gene Name: testis-specific serine kinase substrate
  Uniprot ID: Q9UJT2
  ENSP ID: ENSP00000246801
MASVVVKTIWQSKEIHEAGDTPTGVESCSQLVPEAPRRVTSRAKGIPKKKKAVSFHGVEPQMSHQPMHWCLNLKRSSACTNVSLLNLAAMEPTDSTGTDSTVEDLSGQLTLAGPPASPTLPWDPDDADITEILSGVNSGLVRAKDSITSLKEKTNRVNQHVQSLQSECSVLSENLERRRQEAEELEGYCIQLKENCWKVTRSVEDAEIKTNVLKQNSALLEEKLRYLQQQLQDETPRRQEAELQEPEEKQEPEEKQEPEEKQKPEAGLSWNSLGPAATSQGCPGPPGSPDKPSRPHGLVPAGWGMGPRAGEGPYVSEQELQKLFTGIEELRREVSSLTARWHQEEGAVQEALRLLGGLGGRVDGFLGQWERAQREQAQTARDLQELRGRADELCTMVERSAVSVASLRSELEGLGPLKPILEEFGRQFQNSRRGPDLSMNLDRSHQGNCARCASQGSQLSTESLQQLLDRALTSLVDEVKQRGLTPACPSCQRLHKKILELERQALAKHVRAEALSSTLRLAQDEALRAKNLLLTDKMKPEEKMATLDHLHLKMCSLHDHLSNLPLEGSTGTMGGGSSAGTPPKQGGSAPEQ

SEQ ID NO: 87852 - protein, 392 aa, Homo sapiens
  Payload ID: 17593
  Gene Name: testis-specific serine kinase substrate
  ENSP ID: ENSP00000351691
MGDSCPAVTFRSQKENRAGLQEKLRYLQQQLQDETPRRQEAELQEPEEKQEPEEKQEPEEKQKPEAGLSWNSLGPAATSQGCPGPPGSPDKPSRPHGLVPAGWGMGPRAGEGPYVSEQELQKLFTGIEELRREVSSLTARWHQEEGAVQEALRLLGGLGGRVDGFLGQWERAQREQAQTARDLQELRGRADELCTMVERSAVSVASLRSELEGLGPLKPILEEFGRQFQNSRRGPDLSMNLDRSHQGNCARCASQGSQLSTESLQQLLDRALTSLVDEVKQRGLTPACPSCQRLHKKILELERQALAKHVRAEALSSTLRLAQDEALRAKNLLLTDKMKPEEKMATLDHLHLKMCSLHDHLSNLPLEGSTGTMGGGSSAGTPPKQGGSAPEQ

SEQ ID NO: 87853 - protein, 2136 aa, Homo sapiens
  Payload ID: 17594
  Gene Name: tet methylcytosine dioxygenase 1
  Uniprot ID: Q8NFU7
  ENSP ID: ENSP00000362748
MSRSRHARPSRLVRKEDVNKKKKNSQLRKTTKGANKNVASVKTLSPGKLKQLIQERDVKKKTEPKPPVPVRSLLTRAGAARMNLDRTEVLFQNPESLTCNGFTMALRSTSLSRRLSQPPLVVAKSKKVPLSKGLEKQHDCDYKILPALGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGIAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVVVPLEVIKENKRPQREKKPKVLKADFDNKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTVRNGIKHVHCLPAETNVSFKKFNIEEFGKTLENNSYKFLKDTANHKNAMSSVATDMSCDHLKGRSNVLVFQQPGFNCSSIPHSSHSIINHHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVESTPTSLVTCNVQQKYNQEKGTIQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHQRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 87854 - protein, 1194 aa, Homo sapiens
  Payload ID: 17595
  Gene Name: tet methylcytosine dioxygenase 2
  Uniprot ID: Q6N021
  ENSP ID: ENSP00000265149
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVGLDRRVKLLGLKESSILVKKAKVLRDVLLLSGWFAEAAVKRSYCVWCGSELATPVRLQ

SEQ ID NO: 87855 - protein, 1165 aa, Homo sapiens
  Payload ID: 17595
  Gene Name: tet methylcytosine dioxygenase 2
  Uniprot ID: Q6N021
  ENSP ID: ENSP00000306705
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVGKCQKCTETHGVYPELANLSSDMGFSFFF

SEQ ID NO: 87856 - protein, 2002 aa, Homo sapiens
  Payload ID: 17595
  Gene Name: tet methylcytosine dioxygenase 2
  Uniprot ID: Q6N021
  ENSP ID: ENSP00000369351
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 87857 - protein, 637 aa, Homo sapiens
  Payload ID: 17595
  Gene Name: tet methylcytosine dioxygenase 2
  ENSP ID: ENSP00000378245
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLSTSHKCTKLK

SEQ ID NO: 87858 - protein, 1167 aa, Homo sapiens
  Payload ID: 17595
  Gene Name: tet methylcytosine dioxygenase 2
  ENSP ID: ENSP00000391448
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEER

SEQ ID NO: 87859 - protein, 2023 aa, Homo sapiens
  Payload ID: 17595
  Gene Name: tet methylcytosine dioxygenase 2
  ENSP ID: ENSP00000425443
MIQEEQIQLEGSLVDGPEASLMEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 87860 - protein, 110 aa, Homo sapiens
  Payload ID: 17595
  Gene Name: tet methylcytosine dioxygenase 2
  ENSP ID: ENSP00000426885
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIK

SEQ ID NO: 87861 - protein, 2002 aa, Homo sapiens; identical to SEQ ID NO: 87856
  Payload ID: 17595
  Gene Name: tet methylcytosine dioxygenase 2
  Uniprot ID: Q6N021
  ENSP ID: ENSP00000442788

SEQ ID NO: 87862 - protein, 1702 aa, Homo sapiens
  Payload ID: 17596
  Gene Name: tet methylcytosine dioxygenase 3
  ENSP ID: ENSP00000307803
MHQRRPAEVEIKAGEGAGPWGQGAAVKTGSELSPVDGPVPGQMDSGPVYHGDSRQLSASGVPVNGAREPAGPSLLGTGGPWRVDQKPDWEAAPGPAHTARLEDAHDLVAFSAVAEAVSSYGALSTRLYETFNREMSREAGNNSRGPRPGPEGCSAGSEDLDTLQTALALARHGMKPPNCNCDGPECPDYLEWLEGKIKSVVMEGGEERPRLPGPLPPGEAGLPAPSTRPLLSSEVPQISPQEGLPLSQSALSIAKEKNISLQTAIAIEALTQLSSALPQPSHSTPQASCPLPEALSPPAPFRSPQSYLRAPSWPVVPPEEHSSFAPDSSAFPPATPRTEFPEAWGTDTPPATPRSSWPMPRPSPDPMAELEQLLGSASDYIQSVFKRPEALPTKPKVKVEAPSSSPAPAPSPVLQREAPTPSSEPDTHQKAQTALQQHLHHKRSLFLEQVHDTSFPAPSEPSAPGWWPPPSSPVPRLPDRPPKEKKKKLPTPAGGPVGTEKAAPGIKPSVRKPIQIKKSRPREAQPLFPPVRQIVLEGLRSPASQEVQAHPPAPLPASQGSAVPLPPEPSLALFAPSPSRDSLLPPTQEMRSPSPMTALQPGSTGPLPPADDKLEELIRQFEAEFGDSFGLPGPPSVPIQDPENQQTCLPAPESPFATRSPKQIKIESSGAVTVLSTTCFHSEEGGQEATPTKAENPLTPTLSGFLESPLKYLDTPTKSLLDTPAKRAQAEFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTVVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLDRAWQSFGLPLGSSEKLFGALKSEEKLWDPFSLEEGPAEEPPSKGAVKEEKGGGGAEEEEEELWSDSEHNFLDENIGGVAVAPAHGSILIECARRELHATTPLKKPNRCHPTRISLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 87863 - protein, 1795 aa, Homo sapiens
  Payload ID: 17596
  Gene Name: tet methylcytosine dioxygenase 3
  Uniprot ID: O43151
  ENSP ID: ENSP00000386869
MSQFQVPLAVQPDLPGLYDFPQRQVMVGSFPGSGLSMAGSESQLRGGGDGRKKRKRCGTCEPCRRLENCGACTSCTNRRTHQICKLRKCEVLKKKVGLLKEVEIKAGEGAGPWGQGAAVKTGSELSPVDGPVPGQMDSGPVYHGDSRQLSASGVPVNGAREPAGPSLLGTGGPWRVDQKPDWEAAPGPAHTARLEDAHDLVAFSAVAEAVSSYGALSTRLYETFNREMSREAGNNSRGPRPGPEGCSAGSEDLDTLQTALALARHGMKPPNCNCDGPECPDYLEWLEGKIKSVVMEGGEERPRLPGPLPPGEAGLPAPSTRPLLSSEVPQISPQEGLPLSQSALSIAKEKNISLQTAIAIEALTQLSSALPQPSHSTPQASCPLPEALSPPAPFRSPQSYLRAPSWPVVPPEEHSSFAPDSSAFPPATPRTEFPEAWGTDTPPATPRSSWPMPRPSPDPMAELEQLLGSASDYIQSVFKRPEALPTKPKVKVEAPSSSPAPAPSPVLQREAPTPSSEPDTHQKAQTALQQHLHHKRSLFLEQVHDTSFPAPSEPSAPGWWPPPSSPVPRLPDRPPKEKKKKLPTPAGGPVGTEKAAPGIKPSVRKPIQIKKSRPREAQPLFPPVRQIVLEGLRSPASQEVQAHPPAPLPASQGSAVPLPPEPSLALFAPSPSRDSLLPPTQEMRSPSPMTALQPGSTGPLPPADDKLEELIRQFEAEFGDSFGLPGPPSVPIQDPENQQTCLPAPESPFATRSPKQIKIESSGAVTVLSTTCFHSEEGGQEATPTKAENPLTPTLSGFLESPLKYLDTPTKSLLDTPAKRAQAEFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTVVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLDRAWQSFGLPLGSSEKLFGALKSEEKLWDPFSLEEGPAEEPPSKGAVKEEKGGGGAEEEEEELWSDSEHNFLDENIGGVAVAPAHGSILIECARRELHATTPLKKPNRCHPTRISLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 87864 - protein, 411 aa, Homo sapiens
  Payload ID: 17597
  Gene Name: tetra-peptide repeat homeobox 1
  Uniprot ID: Q8N7U7
  ENSP ID: ENSP00000323455
MLSLREQQLQVWFKNRRAKLARERRLQQQPQRVPGQRGRGARAAPLVPAASASAPQRGPSGILPAAEPTICSLHQAWGGPGCRAQKGIPAALSPGPGPIPAPIPGPAQIPGPLPGSIPGPIPGPAQIPSPIPAPIPGPISGPVQIPGPFRGPIPGPISGPAPIPGPISGPFSGPNPGPIPGPNPGPIPGPISGPIPGPISVPIPGPIPGPISGPISGPNPGPIPGPIPGPISGPNPGPIPGPISGPNPGLIPGPIPGPISGPGPIIGPIPSPAQIPGPGRLQGPGPILSPGRMRSPGSLPGLAPILGPGSGPGSGSVPAPIPGPGSLPAPAPLWPQSPDASDFLPDTQLFPHFTELLLPLDPLEGSSVSTMTSQYQEGDDSMGKKHSGSQPQEEGGSVNENHSGPRLLLDL

SEQ ID NO: 87865 - protein, 401 aa, Homo sapiens
  Payload ID: 17597
  Gene Name: tetra-peptide repeat homeobox 1
  ENSP ID: ENSP00000438712
MLSLREQQLQVWFKNRRAKLARERRLQQQPQRVPGQRGRGARAAPLVPAASASAPQRGPSGILPAAEPTICSLHQAWGGPGCRAQKGIPAALSPGPGPIPAPIPGPAQIPGPLPGSIPGPIPGPAQIPSPIPAPIPGPISGPVQIPGPFRGPIPGPISGPFSGPNPGPIPGPNPGPIPGPISGPIPGPISVPIPGPIPGPISGPISGPNPGPIPGPIPGPISGPNPGPIPGPISGPNPGLIPGPIPGPISGPGPIIGPIPSPAQIPGPGRLQGPGPILSPGRMRSPGSLPGLAPILGPGSGPGSGSVPAPIPGPGSLPAPAPLWPQSPDASDFLPDTQLFPHFTELLLPLDPLEGSSVSTMTSQYQEGDDSMGKKHSGSQPQEEGGSVNENHSGPRLLLDL

SEQ ID NO: 87866 - protein, 508 aa, Homo sapiens
  Payload ID: 17597
  Gene Name: tetra-peptide repeat homeobox 1
  ENSP ID: ENSP00000438832
MDEAGNHHSEQTITRTENQTPHALAHRRMGPCLSCSQLYSQYLGLSQTHSSPPLALDPPRRQRQERTVYTESQQKVLEFYFQKDQYPNYDQRLNLAEMLSLREQQLQVWFKNRRAKLARERRLQQQPQRVPGQRGRGARAAPLVPAASASAPQRGPSGILPAAEPTICSLHQAWGGPGCRAQKGIPAALSPGPGPIPAPIPGPAQIPGPLPGSIPGPIPGPAQIPSPIPAPIPGPISGPVQIPGPFRGPIPGPISGPAPIPGPISGPFSGPNPGPIPGPNPGPIPGPISGPIPGPISVPIPGPIPGPISGPISGPNPGPIPGPIPGPISGPNPGPIPGPISGPNPGLIPGPIPGPISGPGPIIGPIPSPAQIPGPGRLQGPGPILSPGRMRSPGSLPGLAPILGPGSGPGSGSVPAPIPGPGSLPAPAPLWPQSPDASDFLPDTQLFPHFTELLLPLDPLEGSSVSTMTSQYQEGDDSMGKKHSGSQPQEEGGSVNENHSGPRLLLDL

SEQ ID NO: 87867 - protein, 139 aa, Homo sapiens
  Payload ID: 17598
  Gene Name: tetra-peptide repeat homeobox-like
  ENSP ID: ENSP00000322097
MQDPRHPQGLPLSPGLPKRQRQDRTIYNWKQQEVLENHFKEEQYPDYDTRQELAEMLNLREYQVQVWFKNRRAKRSRERWFQKQLQQLQKHPQQQHPQQQHPQQQLQQQQPQQQPQQQQPQQQPQQQQPQQQQLHQQPQ

SEQ ID NO: 87868 - protein, 139 aa, Homo sapiens; identical to SEQ ID NO: 87867
  Payload ID: 17598
  Gene Name: tetra-peptide repeat homeobox-like
  ENSP ID: ENSP00000400448

SEQ ID NO: 87869 - protein, 139 aa, Homo sapiens; identical to SEQ ID NO: 87867
  Payload ID: 17598
  Gene Name: tetra-peptide repeat homeobox-like
  ENSP ID: ENSP00000400824

SEQ ID NO: 87870 - protein, 139 aa, Homo sapiens; identical to SEQ ID NO: 87867
  Payload ID: 17598
  Gene Name: tetra-peptide repeat homeobox-like
  ENSP ID: ENSP00000432662

SEQ ID NO: 87871 - protein, 97 aa, Homo sapiens
  Payload ID: 17598
  Gene Name: tetra-peptide repeat homeobox-like
  ENSP ID: ENSP00000435219
MQDPRHPQGLPLSPGLPKRQRQDRTIYNWKQQEVLENHFKEEQYPDYDTRQELAEMLNLREYQVQVWFKNRRAKRSRERWFQKQLQQLQKHPQQQHP

SEQ ID NO: 87872 - protein, 89 aa, Homo sapiens
  Payload ID: 17598
  Gene Name: tetra-peptide repeat homeobox-like
  ENSP ID: ENSP00000435227
MQDPRHPQGLPLSPGLPKRQRQDRTIYNWKQQEVLENHFKEEQYPDYDTRQELAEMLNLREYQVQVWFKNRRAKRSRERWFQKQLQQLQ

SEQ ID NO: 87873 - protein, 121 aa, Homo sapiens
  Payload ID: 17598
  Gene Name: tetra-peptide repeat homeobox-like
  ENSP ID: ENSP00000435438
MQDPRHPQGLPLSPGLPKRQRQDRTIYNWKQQEVLENHFKEEQYPDYDTRQELAEMLNLREYQVQVWFKNRRAKRSRERWFQKQLQQLQKHPQQQHPQQQHPQQQLQQQQPQQQPQQQQPQ

SEQ ID NO: 87874 - protein, 67 aa, Homo sapiens
  Payload ID: 17598
  Gene Name: tetra-peptide repeat homeobox-like
  ENSP ID: ENSP00000435511
MQDPRHPQGLPLSPGLPKRQRQDRTIYNWKQQEVLENHFKEEQYPDYDTRQELAEMLNLREYQVQVW

SEQ ID NO: 87875 - protein, 58 aa, Homo sapiens
  Payload ID: 17598
  Gene Name: tetra-peptide repeat homeobox-like
  ENSP ID: ENSP00000435853
MQDPRHPQGLPLSPGLPKRQRQDRTIYNWKQQEVLENHFKEEQYPDYDTRQELAEMLN

SEQ ID NO: 87876 - protein, 84 aa, Homo sapiens
  Payload ID: 17598
  Gene Name: tetra-peptide repeat homeobox-like
  ENSP ID: ENSP00000436919
MQDPRHPQGLPLSPGLPKRQRQDRTIYNWKQQEVLENHFKEEQYPDYDTRQELAEMLNLREYQVQVWFKNRRAKRSRERWFQKQ

SEQ ID NO: 87877 - protein, 66 aa, Homo sapiens
  Payload ID: 17598
  Gene Name: tetra-peptide repeat homeobox-like
  ENSP ID: ENSP00000437227
MQDPRHPQGLPLSPGLPKRQRQDRTIYNWKQQEVLENHFKEEQYPDYDTRQELAEMLNLREYQVQV

SEQ ID NO: 87878 - protein, 241 aa, Homo sapiens
  Payload ID: 17599
  Gene Name: tetraspanin 1
  Uniprot ID: O60635
  ENSP ID: ENSP00000361072
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 87879 - protein, 393 aa, Homo sapiens
  Payload ID: 17600
  Gene Name: tetraspanin 10
  ENSP ID: ENSP00000480492
MHRLAQGRSQDQPSSPATEEPANLSRRLCWGLSVPASRMEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPADPMLGLALGGLVVSAVSLAGYLGALCENTCLLRGFSGGILAFLVLEAVAGALVVALWGPLQDSLEHTLRVAIAHYQDDPDLRFLLDQVQLGLRCCGAASYQDWQQNLYFNCSSPGVQACSLPASCCIDPREDGASVNDQCGFGVLRLDADAAQRVVYLEGCGPPLRRWLRANLAASGGYAIAVVLLQGAELLLAARLLGALAARRGAAYGPGARGEDRAGPQSPSPGAPPAAKPARG

SEQ ID NO: 87880 - protein, 235 aa, Homo sapiens
  Payload ID: 17600
  Gene Name: tetraspanin 10
  ENSP ID: ENSP00000482695
MEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPADPMLGLALGGLVVSAVSLAGYLGALCENTCLLRGFSGGILAFLVLEAVAGALVVALWGPLQDSLEHTLRVAIAHYQDDPDLRFLLDQVQLGLRCCGAASYQDWQQNLYCLSSPCSSQ

SEQ ID NO: 87881 - protein, 355 aa, Homo sapiens
  Payload ID: 17600
  Gene Name: tetraspanin 10
  ENSP ID: ENSP00000484664
MEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPADPMLGLALGGLVVSAVSLAGYLGALCENTCLLRGFSGGILAFLVLEAVAGALVVALWGPLQDSLEHTLRVAIAHYQDDPDLRFLLDQVQLGLRCCGAASYQDWQQNLYFNCSSPGVQACSLPASCCIDPREDGASVNDQCGFGVLRLDADAAQRVVYLEGCGPPLRRWLRANLAASGGYAIAVVLLQGAELLLAARLLGALAARRGAAYGPGARGEDRAGPQSPSPGAPPAAKPARG

SEQ ID NO: 87882 - protein, 253 aa, Homo sapiens
  Payload ID: 17601
  Gene Name: tetraspanin 11
  Uniprot ID: A1L157
  ENSP ID: ENSP00000261177
MAHYKTEQDDWLIIYLKYLLFVFNFFFWVGGAAVLAVGIWTLVEKSGYLSVLASSTFAASAYILIFAGVLVMVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 87883 - protein, 253 aa, Homo sapiens; identical to SEQ ID NO: 87882
  Payload ID: 17601
  Gene Name: tetraspanin 11
  Uniprot ID: A1L157
  ENSP ID: ENSP00000437403

SEQ ID NO: 87884 - protein, 41 aa, Homo sapiens
  Payload ID: 17601
  Gene Name: tetraspanin 11
  ENSP ID: ENSP00000443890
MAHYKTEQDDWLIIYLKYLLFVFNFFFWVSEFCTHILFPEH

SEQ ID NO: 87885 - protein, 182 aa, Homo sapiens
  Payload ID: 17601
  Gene Name: tetraspanin 11
  ENSP ID: ENSP00000445503
MVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 87886 - protein, 305 aa, Homo sapiens
  Payload ID: 17602
  Gene Name: tetraspanin 12
  Uniprot ID: O95859
  ENSP ID: ENSP00000222747
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLTHAWNFFQREFKCCGVVYFTDWLEMTEMDWPPDSCCVREFPGCSKQAHQEDLSDLYQEGCGKKMYSFLRGTKQLQVLRFLGISIGVTQILAMILTITLLWALYYDRREPGTDQMMSLKNDNSQHLSCPSVELLKPSLSRIFEHTSMANSFNTHFEMEEL

SEQ ID NO: 87887 - protein, 95 aa, Homo sapiens
  Payload ID: 17602
  Gene Name: tetraspanin 12
  ENSP ID: ENSP00000388819
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAW

SEQ ID NO: 87888 - protein, 42 aa, Homo sapiens
  Payload ID: 17602
  Gene Name: tetraspanin 12
  ENSP ID: ENSP00000397411
NLLLLAWYFGSLLVIFCVELACGVWTYEQELMSEESHLAIEQ

SEQ ID NO: 87889 - protein, 305 aa, Homo sapiens; identical to SEQ ID NO: 87886
  Payload ID: 17602
  Gene Name: tetraspanin 12
  Uniprot ID: O95859
  ENSP ID: ENSP00000397699

SEQ ID NO: 87890 - protein, 120 aa, Homo sapiens
  Payload ID: 17602
  Gene Name: tetraspanin 12
  ENSP ID: ENSP00000399059
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELM

SEQ ID NO: 87891 - protein, 112 aa, Homo sapiens
  Payload ID: 17602
  Gene Name: tetraspanin 12
  ENSP ID: ENSP00000404942
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGV

SEQ ID NO: 87892 - protein, 147 aa, Homo sapiens
  Payload ID: 17602
  Gene Name: tetraspanin 12
  ENSP ID: ENSP00000411158
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLT

SEQ ID NO: 87893 - protein, 204 aa, Homo sapiens
  Payload ID: 17603
  Gene Name: tetraspanin 13
  Uniprot ID: O95857
  ENSP ID: ENSP00000262067
MVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 87894 - protein, 213 aa, Homo sapiens
  Payload ID: 17604
  Gene Name: tetraspanin 14
  ENSP ID: ENSP00000344076
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFNQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 87895 - protein, 270 aa, Homo sapiens
  Payload ID: 17604
  Gene Name: tetraspanin 14
  Uniprot ID: Q8NG11
  ENSP ID: ENSP00000361229
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 87896 - protein, 223 aa, Homo sapiens
  Payload ID: 17604
  Gene Name: tetraspanin 14
  ENSP ID: ENSP00000361230
MERKVLPCFLCLFQGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFL

SEQ ID NO: 87897 - protein, 270 aa, Homo sapiens; identical to SEQ ID NO: 87895
  Payload ID: 17604
  Gene Name: tetraspanin 14
  Uniprot ID: Q8NG11
  ENSP ID: ENSP00000361231

SEQ ID NO: 87898 - protein, 253 aa, Homo sapiens
  Payload ID: 17604
  Gene Name: tetraspanin 14
  Uniprot ID: Q8NG11
  ENSP ID: ENSP00000361237
MHYYRYSNAKVSCWYKYLLFSYNIIFWGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 87899 - protein, 270 aa, Homo sapiens; identical to SEQ ID NO: 87895
  Payload ID: 17604
  Gene Name: tetraspanin 14
  Uniprot ID: Q8NG11
  ENSP ID: ENSP00000396270

SEQ ID NO: 87900 - protein, 147 aa, Homo sapiens
  Payload ID: 17604
  Gene Name: tetraspanin 14
  Uniprot ID: Q8NG11
  ENSP ID: ENSP00000418195
MHYYRYSNAKVSCWYKYLLFSYNIIFWNQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 87901 - protein, 253 aa, Homo sapiens; identical to SEQ ID NO: 87898
  Payload ID: 17604
  Gene Name: tetraspanin 14
  Uniprot ID: Q8NG11
  ENSP ID: ENSP00000480263

SEQ ID NO: 87902 - protein, 294 aa, Homo sapiens
  Payload ID: 17605
  Gene Name: tetraspanin 15
  Uniprot ID: O95858
  ENSP ID: ENSP00000362387
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 87903 - protein, 160 aa, Homo sapiens
  Payload ID: 17605
  Gene Name: tetraspanin 15
  ENSP ID: ENSP00000404528
LQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQITGVSD

SEQ ID NO: 87904 - protein, 245 aa, Homo sapiens
  Payload ID: 17606
  Gene Name: tetraspanin 16
  Uniprot ID: Q9UKR8
  ENSP ID: ENSP00000319486
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQRWGSRYVAQAGLELLA

SEQ ID NO: 87905 - protein, 160 aa, Homo sapiens
  Payload ID: 17606
  Gene Name: tetraspanin 16
  Uniprot ID: Q9UKR8
  ENSP ID: ENSP00000338759
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKGLSKYFFSSL

SEQ ID NO: 87906 - protein, 38 aa, Homo sapiens
  Payload ID: 17606
  Gene Name: tetraspanin 16
  ENSP ID: ENSP00000466520
RDVSPNVIHQKKLRLGEGTSLVQDHRALAELEFEAPLA

SEQ ID NO: 87907 - protein, 219 aa, Homo sapiens
  Payload ID: 17606
  Gene Name: tetraspanin 16
  Uniprot ID: Q9UKR8
  ENSP ID: ENSP00000466751
MAEIHTPYSSLKKLLSLLNGFVAVSGIILVGLGIGGKCGGASLTNVLGLSSAYLLHVGNLCLVMGCITVLLGCAGWYGATKESRGTLLFVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQLPGILATLLLFIKLG

SEQ ID NO: 87908 - protein, 244 aa, Homo sapiens
  Payload ID: 17606
  Gene Name: tetraspanin 16
  Uniprot ID: Q9UKR8
  ENSP ID: ENSP00000467341
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQLPGILATLLLFIKLG

SEQ ID NO: 87909 - protein, 160 aa, Homo sapiens; identical to SEQ ID NO: 87905
  Payload ID: 17606
  Gene Name: tetraspanin 16
  Uniprot ID: Q9UKR8
  ENSP ID: ENSP00000480759

SEQ ID NO: 87910 - protein, 188 aa, Homo sapiens
  Payload ID: 17607
  Gene Name: tetraspanin 17
  Uniprot ID: Q96FV3
  ENSP ID: ENSP00000298564
MPGKHQHFQEPEVGCCGKYFLFGFNIVFWFSVFLGLIFFLELATGILAFVFKDWIRDQLNLFINNNVKAYRDDIDLQNLIDFAQEYEDVLNTQCGYDVRLKLELEQQGFIHTKGCVGQFEKWLQDNLIVVAGVFMGIALLQVPLWPHVPLPLPGPPSLSPHLSSVLQIFGICLAQNLVSDIKAVKANW

SEQ ID NO: 87911 - protein, 332 aa, Homo sapiens
  Payload ID: 17607
  Gene Name: tetraspanin 17
  ENSP ID: ENSP00000309036
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLVRGELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 87912 - protein, 329 aa, Homo sapiens
  Payload ID: 17607
  Gene Name: tetraspanin 17
  Uniprot ID: Q96FV3
  ENSP ID: ENSP00000422053
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 87913 - protein, 203 aa, Homo sapiens
  Payload ID: 17607
  Gene Name: tetraspanin 17
  ENSP ID: ENSP00000423610
  MOD_RES (1)..(1): Any amino acid
XGKHQHFQEPEVGCCGKYFLFGFNIVFWFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANW

SEQ ID NO: 87914 - protein, 257 aa, Homo sapiens
  Payload ID: 17607
  Gene Name: tetraspanin 17
  ENSP ID: ENSP00000423957
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFLATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKAN

SEQ ID NO: 87915 - protein, 309 aa, Homo sapiens
  Payload ID: 17607
  Gene Name: tetraspanin 17
  ENSP ID: ENSP00000425212
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFDWIRDQLNLFINNNVKAYRDDIDLQNLIDFAQEYWSCCGARGPNDWNLNIYFNCTDLNPSRERCGVPFSCCVRDPAEDVLNTQCGYDVRLKLVRGELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 87916 - protein, 58 aa, Homo sapiens
  Payload ID: 17607
  Gene Name: tetraspanin 17
  ENSP ID: ENSP00000425975
MPGKHQHFQEPEVGCCGKYFLFGFNIVFWVSAGCWEPCSWLSASGPGVRRAFSRTSQR

SEQ ID NO: 87917 - protein, 263 aa, Homo sapiens
  Payload ID: 17607
  Gene Name: tetraspanin 17
  Uniprot ID: Q96FV3
  ENSP ID: ENSP00000426650
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLEQME

SEQ ID NO: 87918 - protein, 248 aa, Homo sapiens
  Payload ID: 17608
  Gene Name: tetraspanin 18
  Uniprot ID: Q96SJ8
  ENSP ID: ENSP00000339820
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 87919 - protein, 157 aa, Homo sapiens
  Payload ID: 17608
  Gene Name: tetraspanin 18
  ENSP ID: ENSP00000427942
MPEELPRWSTMEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITVSD

SEQ ID NO: 87920 - protein, 271 aa, Homo sapiens
  Payload ID: 17608
  Gene Name: tetraspanin 18
  ENSP ID: ENSP00000429020
  MOD_RES (1)..(1): Any amino acid
XWSTMEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIEEERAHSVSQATGILYQLPASPQAFQSPGTLGATA

SEQ ID NO: 87921 - protein, 248 aa, Homo sapiens; identical to SEQ ID NO: 87918
  Payload ID: 17608
  Gene Name: tetraspanin 18
  Uniprot ID: Q96SJ8
  ENSP ID: ENSP00000429993

SEQ ID NO: 87922 - protein, 76 aa, Homo sapiens
  Payload ID: 17608
  Gene Name: tetraspanin 18
  ENSP ID: ENSP00000430343
MPEELPRWSTMEGDCLSCMKYLMFVFNFFIFLGGACLLAIGIWVMVDPTGFREIVAANPLLLTGAYILLAMGGLLF

SEQ ID NO: 87923 - protein, 138 aa, Homo sapiens
  Payload ID: 17608
  Gene Name: tetraspanin 18
  ENSP ID: ENSP00000433362
MEGDCLSCMKYLMFVFNFFIFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLN

SEQ ID NO: 87924 - protein, 146 aa, Homo sapiens
  Payload ID: 17608
  Gene Name: tetraspanin 18
  ENSP ID: ENSP00000433592
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITVS

SEQ ID NO: 87925 - protein, 79 aa, Homo sapiens
  Payload ID: 17608
  Gene Name: tetraspanin 18
  ENSP ID: ENSP00000434625
MEGDCLSCMKYLMFVFNFFIFLGGACLLAIGIWVMVDPTGFREIVAANPLLLTGAYILLAMGGLLFLLGFLGCCGAVRE

SEQ ID NO: 87926 - protein, 53 aa, Homo sapiens
  Payload ID: 17609
  Gene Name: tetraspanin 19
  ENSP ID: ENSP00000408184
MLRNNKTIIIKYFLNLINGAFLVLGLLFMGFGAWLLLDRNNFLTAFGGVSLCH

SEQ ID NO: 87927 - protein, 248 aa, Homo sapiens
  Payload ID: 17609
  Gene Name: tetraspanin 19
  Uniprot ID: P0C672
  ENSP ID: ENSP00000433816
MLRNNKTIIIKYFLNLINGAFLVLGLLFMGFGAWLLLDRNNFLTAFDENNHFIVPISQILIGMGSSTVLFCLLGYIGIHNEIRWLLIVYAVLITWTFAVQVVLSAFIITKKEEVQQLWHDKIDFVISEYGSKDKPEDITKWTILNALQKTLQCCGQHNYTDWIKNKNKENSGQVPCSCTKSTLRKWFCDEPLNATYLEGCENKISAWYNVNVLTLIGINFGLLTSEVFQVSLTVCFFKNIKNIIHAEM

SEQ ID NO: 87928 - protein, 69 aa, Homo sapiens
  Payload ID: 17609
  Gene Name: tetraspanin 19
  ENSP ID: ENSP00000440661
  MOD_RES (1)..(1): Any amino acid
XCCGQHNYTDWIKNKNKENSGQVPCSCTKSTLRKWFCDEPLNATYLEVFQVSLTVCFFKNIKNIIHAEM

SEQ ID NO: 87929 - protein, 88 aa, Homo sapiens
  Payload ID: 17609
  Gene Name: tetraspanin 19
  ENSP ID: ENSP00000446898
MLRNNKTIIIKYFLNLINGAFLVLGLLFMGFGAWLLLDRNNFLTAFDENNHFIVPISQILIGMGSSTVLFCLLGYIGIHNEIRWLLIV

SEQ ID NO: 87930 - protein, 159 aa, Homo sapiens
  Payload ID: 17609
  Gene Name: tetraspanin 19
  ENSP ID: ENSP00000449663
MLRNNKTIIIKYFLNLINGAFLVLGLLFMGFGAWLLLDRNNFLTAFDENNHFIVPISQILIGMGSSTVLFCLLGYIGIHNEIRWLLIVVESRSVTRLECSGTISAHCNLHLPDSSDSPASDSEVAGITVCSIDNMDLCCSGCTFSIHHHKERGGSATMA

SEQ ID NO: 87931 - protein, 196 aa, Homo sapiens
  Payload ID: 17610
  Gene Name: tetraspanin 2
  ENSP ID: ENSP00000358528
MGRFRGGLRCIKYLLLGFNLLFWLAGSAVIAFGLWFRFGGAIKELSSEDKSPEYFYVGLYVLVGAGALMMAVGFFGCCGAMRESQCVLGSAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 87932 - protein, 221 aa, Homo sapiens
  Payload ID: 17610
  Gene Name: tetraspanin 2
  Uniprot ID: O60636
  ENSP ID: ENSP00000358529
MGRFRGGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 87933 - protein, 187 aa, Homo sapiens
  Payload ID: 17610
  Gene Name: tetraspanin 2
  ENSP ID: ENSP00000415256
GLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKIFGMIFSMVLCCAIRNSRDVI

SEQ ID NO: 87934 - protein, 253 aa, Homo sapiens
  Payload ID: 17611
  Gene Name: tetraspanin 3
  Uniprot ID: O60637
  ENSP ID: ENSP00000267970
MGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 87935 - protein, 228 aa, Homo sapiens
  Payload ID: 17611
  Gene Name: tetraspanin 3
  Uniprot ID: O60637
  ENSP ID: ENSP00000341329
MGQCGITSSKTVLVFLNLIFWGAAGILCYVGAYVFITYDDYDHFFEDVYTLIPAVVIIAVGALLFIIGLIGCCATIRESRCGLATVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 87936 - protein, 189 aa, Homo sapiens
  Payload ID: 17611
  Gene Name: tetraspanin 3
  Uniprot ID: O60637
  ENSP ID: ENSP00000407243
MGQCGITSSKTVLVFLNLIFWFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 87937 - protein, 164 aa, Homo sapiens
  Payload ID: 17611
  Gene Name: tetraspanin 3
  ENSP ID: ENSP00000452835
MGQCGITSSKTVLVFLNLIFWVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 87938 - protein, 45 aa, Homo sapiens
  Payload ID: 17611
  Gene Name: tetraspanin 3
  ENSP ID: ENSP00000453613
MMHVIWAALAFAAIQLLGMLCACIVLCRRSRDPAYELLITGGTYA

SEQ ID NO: 87939 - protein, 45 aa, Homo sapiens; identical to SEQ ID NO: 87938
  Payload ID: 17611
  Gene Name: tetraspanin 3
  ENSP ID: ENSP00000453868

SEQ ID NO: 87940 - protein, 210 aa, Homo sapiens
  Payload ID: 17612
  Gene Name: tetraspanin 31
  Uniprot ID: Q12999
  ENSP ID: ENSP00000257910
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 87941 - protein, 128 aa, Homo sapiens
  Payload ID: 17612
  Gene Name: tetraspanin 31
  ENSP ID: ENSP00000446482
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQIILRCTASGLLGYLLPLGCLVNFP

SEQ ID NO: 87942 - protein, 126 aa, Homo sapiens
  Payload ID: 17612
  Gene Name: tetraspanin 31
  ENSP ID: ENSP00000448209
MVCGGFACSKNALCALNVVYMLVSLLLIGVAAWGKGLGLVSSIHIIGGVIAVGVFLLLIAVAGLICKSQSPTCQMCGEKFLKHSDEALKILGGVGLFFSFTEILGVWLAMRFRNQKDPRANPSAFL

SEQ ID NO: 87943 - protein, 86 aa, Homo sapiens
  Payload ID: 17612
  Gene Name: tetraspanin 31
  ENSP ID: ENSP00000449131
MIILGLVFIFQFVISCSCLAINRSKQTDVINASWWVMSNKTRDELERSFDCCGLFNLTTLYQQDYDFCTAICKSQSPTCQMCGEKF

SEQ ID NO: 87944 - protein, 127 aa, Homo sapiens
  Payload ID: 17612
  Gene Name: tetraspanin 31
  ENSP ID: ENSP00000449199
MVCGGFACSKNALCALNVVYMTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 87945 - protein, 72 aa, Homo sapiens
  Payload ID: 17612
  Gene Name: tetraspanin 31
  ENSP ID: ENSP00000449312
MIILGLVFIFQFVISCSCLAINRSKQTDVINASWWVMSNKTRDELERSFDCCGLFNLTTLYQQDYDFCTAIC

SEQ ID NO: 87946 - protein, 113 aa, Homo sapiens
  Payload ID: 17612
  Gene Name: tetraspanin 31
  ENSP ID: ENSP00000450195
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQMSSMLLGGS

SEQ ID NO: 87947 - protein, 320 aa, Homo sapiens
  Payload ID: 17613
  Gene Name: tetraspanin 32
  Uniprot ID: Q96QS1
  ENSP ID: ENSP00000182290
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRACGRQPQEPSLLRCSQGGPTHCLHSEAVAIGPRGCSGSLRWLQESDAAPLPLSCHLAAHRALQGRSRGGLSGCPERGLSD

SEQ ID NO: 87948 - protein, 143 aa, Homo sapiens
  Payload ID: 17613
  Gene Name: tetraspanin 32
  ENSP ID: ENSP00000343285
MPHTLSLPYPQLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKVSVLWEEVSFQPSGEHRG

SEQ ID NO: 87949 - protein, 265 aa, Homo sapiens
  Payload ID: 17613
  Gene Name: tetraspanin 32
  ENSP ID: ENSP00000370509
MVTLTYFGAHFAVIRRASLEKNPYQAVHQWAFSAGLSLVGLLTLGAVLSAAATVREAQGLMAGVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRACGRQPQEPSLLRCSQGGPTHCLHSEAVAIGPRGCSGSLRWLQESDAAPLPLSCHLAAHRALQGRSRGGLSGCPERGLSD

SEQ ID NO: 87950 - protein, 253 aa, Homo sapiens
  Payload ID: 17613
  Gene Name: tetraspanin 32
  Uniprot ID: Q96QS1
  ENSP ID: ENSP00000370513
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRSPGQKSRWAQWVP

SEQ ID NO: 87951 - protein, 258 aa, Homo sapiens
  Payload ID: 17613
  Gene Name: tetraspanin 32
  Uniprot ID: Q96QS1
  ENSP ID: ENSP00000395018
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTLGPQGQIHPDPTSMWPPAPGAQPLEMLPGWTHTLSPLRSSCYWSKRMLG

SEQ ID NO: 87952 - protein, 137 aa, Homo sapiens
  Payload ID: 17613
  Gene Name: tetraspanin 32
  ENSP ID: ENSP00000405001
MGPWSRVRVAKCQMLVTCFFILVTAAGPLCGHHGDSYLLRGPLCCHPPSVPGEEPVPGCAPMGLLCGVEPGGPPDSGSRAERCSHREGGPGPHGRGLPVLLPGVLRTGAGGVLETPQPHPAPILPSWMLTCLEEGPA

SEQ ID NO: 87953 - protein, 309 aa, Homo sapiens
  Payload ID: 17613
  Gene Name: tetraspanin 32
  ENSP ID: ENSP00000405205
MPHTLSLPYPQLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRACGRQPQEPSLLRCSQGGPTHCLHSEAVAIGPRGCSGSLRWLQESDAAPLPLSCHLAAHRALQGRSRGGLSGCPERGLSD

SEQ ID NO: 87954 - protein, 265 aa, Homo sapiens; identical to SEQ ID NO: 87949
  Payload ID: 17613
  Gene Name: tetraspanin 32
  ENSP ID: ENSP00000482901

SEQ ID NO: 87955 - protein, 283 aa, Homo sapiens
  Payload ID: 17614
  Gene Name: tetraspanin 33
  Uniprot ID: Q86UF1
  ENSP ID: ENSP00000483872
MARRPRAPAASGEEFSFVSPLVKYLLFFFNMLFWVISMVMVAVGVYARLMKHAEAALACLAVDPAILLIVVGVLMFLLTFCGCIGSLRENICLLQTFSLCLTAVFLLQLAAGILGFVFSDKARGKVSEIINNAIVHYRDDLDLQNLIDFGQKKFSCCGGISYKDWSQNMYFNCSEDNPSRERCSVPYSCCLPTPDQAVINTMCGQGMQAFDYLEASKVIYTNGCIDKLVNWIHSNLFLLGGVALGLAIPQLVGILLSQILVNQIKDQIKLQLYNQQHRADPWY

SEQ ID NO: 87956 - protein, 204 aa, Homo sapiens
  Payload ID: 17615
  Gene Name: tetraspanin 4
  ENSP ID: ENSP00000324304
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 87957 - protein, 174 aa, Homo sapiens
  Payload ID: 17615
  Gene Name: tetraspanin 4
  ENSP ID: ENSP00000380551
MAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 87958 - protein, 238 aa, Homo sapiens
  Payload ID: 17615
  Gene Name: tetraspanin 4
  Uniprot ID: O14817
  ENSP ID: ENSP00000380552
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 87959 - protein, 238 aa, Homo sapiens; identical to SEQ ID NO: 87958
  Payload ID: 17615
  Gene Name: tetraspanin 4
  Uniprot ID: O14817
  ENSP ID: ENSP00000380553

SEQ ID NO: 87960 - protein, 238 aa, Homo sapiens; identical to SEQ ID NO: 87958
  Payload ID: 17615
  Gene Name: tetraspanin 4
  Uniprot ID: O14817
  ENSP ID: ENSP00000380554

SEQ ID NO: 87961 - protein, 238 aa, Homo sapiens; identical to SEQ ID NO: 87958
  Payload ID: 17615
  Gene Name: tetraspanin 4
  Uniprot ID: O14817
  ENSP ID: ENSP00000380555

SEQ ID NO: 87962 - protein, 238 aa, Homo sapiens; identical to SEQ ID NO: 87958
  Payload ID: 17615
  Gene Name: tetraspanin 4
  Uniprot ID: O14817
  ENSP ID: ENSP00000380558

SEQ ID NO: 87963 - protein, 238 aa, Homo sapiens; identical to SEQ ID NO: 87958
  Payload ID: 17615
  Gene Name: tetraspanin 4
  Uniprot ID: O14817
  ENSP ID: ENSP00000386513

SEQ ID NO: 87964 - protein, 257 aa, Homo sapiens
  Payload ID: 17615
  Gene Name: tetraspanin 4
  ENSP ID: ENSP00000386899
MTPRSAGTSAHGAELKRCGMARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 87965 - protein, 174 aa, Homo sapiens; identical to SEQ ID NO: 87957
  Payload ID: 17615
  Gene Name: tetraspanin 4
  ENSP ID: ENSP00000431943

SEQ ID NO: 87966 - protein, 100 aa, Homo sapiens
  Payload ID: 17615
  Gene Name: tetraspanin 4
  ENSP ID: ENSP00000433980
MAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATR

SEQ ID NO: 87967 - protein, 132 aa, Homo sapiens
  Payload ID: 17615
  Gene Name: tetraspanin 4
  ENSP ID: ENSP00000434818
MARACLQAVKYLMFAFNLLFWFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKV

SEQ ID NO: 87968 - protein, 159 aa, Homo sapiens
  Payload ID: 17615
  Gene Name: tetraspanin 4
  ENSP ID: ENSP00000436260
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEV

SEQ ID NO: 87969 - protein, 85 aa, Homo sapiens
  Payload ID: 17615
  Gene Name: tetraspanin 4
  ENSP ID: ENSP00000437266
MARACLQAVKYLMFAFNLLFWLGGCGVLGVGIWLAATQGSFATLSSSFPSLSAANLLIITGAFVMAIGFVGCLGAIKENKCLLLT

SEQ ID NO: 87970 - protein, 268 aa, Homo sapiens
  Payload ID: 17616
  Gene Name: tetraspanin 5
  Uniprot ID: P62079
  ENSP ID: ENSP00000307701
MSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 87971 - protein, 193 aa, Homo sapiens
  Payload ID: 17616
  Gene Name: tetraspanin 5
  ENSP ID: ENSP00000421808
MSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYIPMQVESDVAFHSPAALKIPQKMSSTLSVAMMPGKNQKLTSRL

SEQ ID NO: 87972 - protein, 87 aa, Homo sapiens
  Payload ID: 17616
  Gene Name: tetraspanin 5
  ENSP ID: ENSP00000422351
  MOD_RES (1)..(1): Any amino acid
XVSCCIKYFIFGFNVIFWFLGITFLGIGLWAWNEKGVLSNISSITDLGGFDPVWLFLVVGGVMFILGFAGCIGALRENTFLLKFDKQ

SEQ ID NO: 87973 - protein, 38 aa, Homo sapiens
  Payload ID: 17616
  Gene Name: tetraspanin 5
  ENSP ID: ENSP00000422548
MFILGFAGCIGALRENTFLLKFLKSPVLTEQAENYTFL

SEQ ID NO: 87974 - protein, 110 aa, Homo sapiens
  Payload ID: 17616
  Gene Name: tetraspanin 5
  ENSP ID: ENSP00000423504
MFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCG

SEQ ID NO: 87975 - protein, 197 aa, Homo sapiens
  Payload ID: 17616
  Gene Name: tetraspanin 5
  ENSP ID: ENSP00000423916
MFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 87976 - protein, 60 aa, Homo sapiens
  Payload ID: 17616
  Gene Name: tetraspanin 5
  ENSP ID: ENSP00000426248
MFILGFAGCIGALRENTFLLKFFSVFLGIIFFLELTAGVLAFVFKDWIKDQLYFFINNNI

SEQ ID NO: 87977 - protein, 245 aa, Homo sapiens
  Payload ID: 17617
  Gene Name: tetraspanin 6
  Uniprot ID: O43657
  ENSP ID: ENSP00000362111
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 87978 - protein, 129 aa, Homo sapiens
  Payload ID: 17617
  Gene Name: tetraspanin 6
  ENSP ID: ENSP00000482130
MLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNELIGIFLAYCLSRAITNNQYEIV

SEQ ID NO: 87979 - protein, 137 aa, Homo sapiens
  Payload ID: 17617
  Gene Name: tetraspanin 6
  ENSP ID: ENSP00000482894
MLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQDI

SEQ ID NO: 87980 - protein, 266 aa, Homo sapiens
  Payload ID: 17618
  Gene Name: tetraspanin 7
  ENSP ID: ENSP00000286824
MASRRMETKPVITCLKTLLIIYSFVFWKEKAAGFCGRQDVAMALITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 87981 - protein, 249 aa, Homo sapiens
  Payload ID: 17618
  Gene Name: tetraspanin 7
  Uniprot ID: P41732
  ENSP ID: ENSP00000367743
MASRRMETKPVITCLKTLLIIYSFVFWITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 87982 - protein, 45 aa, Homo sapiens
  Payload ID: 17618
  Gene Name: tetraspanin 7
  ENSP ID: ENSP00000418586
MASRRMETKPVITCLKTLLIIYSFVFWPCLLKRIRSWVSPHLHNK

SEQ ID NO: 87983 - protein, 63 aa, Homo sapiens
  Payload ID: 17618
  Gene Name: tetraspanin 7
  ENSP ID: ENSP00000419290
MASRRMETKPVITCLKTLLIIYSFVFWPYFCFETGAQCCMRYRESARWQTGLFAMVKEEAEIY

SEQ ID NO: 87984 - protein, 43 aa, Homo sapiens
  Payload ID: 17618
  Gene Name: tetraspanin 7
  ENSP ID: ENSP00000419321
MASRRMETKPVITCLKTLLIIYSFVFWIHSHPKFTRTQPIKGS

SEQ ID NO: 87985 - protein, 237 aa, Homo sapiens
  Payload ID: 17619
  Gene Name: tetraspanin 8
  Uniprot ID: P19075
  ENSP ID: ENSP00000247829
MAGVSACIKYSMFTFNFLFWLCGILILALAIWVRVSNDSQAIFGSEDVGSSSYVAVDILIAVGAIIMILGFLGCCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 87986 - protein, 237 aa, Homo sapiens; identical to SEQ ID NO: 87985
  Payload ID: 17619
  Gene Name: tetraspanin 8
  Uniprot ID: P19075
  ENSP ID: ENSP00000377003

SEQ ID NO: 87987 - protein, 237 aa, Homo sapiens; identical to SEQ ID NO: 87985
  Payload ID: 17619
  Gene Name: tetraspanin 8
  Uniprot ID: P19075
  ENSP ID: ENSP00000447160

SEQ ID NO: 87988 - protein, 239 aa, Homo sapiens
  Payload ID: 17620
  Gene Name: tetraspanin 9
  Uniprot ID: O75954
  ENSP ID: ENSP00000011898
MARGCLCCLKYMMFLFNLIFWLCGCGLLGVGIWLSVSQGNFATFSPSFPSLSAANLVIAIGTIVMVTGFLGCLGAIKENKCLLLSFFIVLLVILLAELILLILFFVYMDKVNENAKKDLKEGLLLYHTENNVGLKNAWNIIQAEMRCCGVTDYTDWYPVLGENTVPDRCCMENSQGCGRNATTPLWRTGCYEKVKMWFDDNKHVLGTVGMCILIMQILGMAFSMTLFQHIHRTGKKYDA

SEQ ID NO: 87989 - protein, 271 aa, Homo sapiens
  Payload ID: 17620
  Gene Name: tetraspanin 9
  ENSP ID: ENSP00000384488
MARGCLCCLKYMMFLFNLIFWLCGCGLLGVGIWLSVSQGNFATFSPSFPSLSAANLVIAIGTIVMVTGFLGCLGAIKENKCLLLSFFIVLLVILLAELILLILFFVYMDKVNENAKKDLKEGLLLYHTENNVGLKNAWNIIQAEMRCCGVTDYTDWYPVLGENTVPDRCCMENSQGCGRNATTPLWRTGCYEKVKMWFDDNKHVLGTVGMCILIMQVRGASPAASPTLLASASEGRKHREVKAVLVHGGGSGIHHSYSSLAAVPATVSAEL

SEQ ID NO: 87990 - protein, 59 aa, Homo sapiens
  Payload ID: 17620
  Gene Name: tetraspanin 9
  ENSP ID: ENSP00000412908
MARGCLCCLKYMMFLFNLIFWDPPVGENGLTGLAEGGSVFSCQEVVESGGHLARPALSI

SEQ ID NO: 87991 - protein, 239 aa, Homo sapiens; identical to SEQ ID NO: 87988
  Payload ID: 17620
  Gene Name: tetraspanin 9
  Uniprot ID: O75954
  ENSP ID: ENSP00000444799

SEQ ID NO: 87992 - protein, 2925 aa, Homo sapiens
  Payload ID: 17621
  Gene Name: tetratricopeptide repeat and ankyrin repeat containing 1
  Uniprot ID: O15050
  ENSP ID: ENSP00000416168
MWDPRAARVPPRDLAVLLCNKSNAFFSLGKWNEAFVAAKECLQWDPTYVKGYYRAGYSLLRLHQPYEAARMFFEGLRLVQRSQDQAPVADFLVGVFTTMSSDSIVLQSFLPCFDHIFTTGFPTEVWQSVIEKLAKKGLWHSFLLLSAKKDRLPRNIHVPELSLKSLFEKYVFIGLYEKMEQVPKLVQWLISIGASVETIGPYPLHALMRLCIQARENHLFRWLMDHKPEWKGRINQKDGDGCTVLHVVAAHSPGYLVKRQTEDVQMLLRFGADPTLLDRQSRSVVDVLKRNKNFKAIEKINSHLEKLATCSKDLSGFSNGDGPTSENDIFRKVLEQLVKYMNSGNRLLHKNFLKQEVVQRFLRLLSTLQEIPPDLVCDINQDCATTVFKFLLEKQRWPEVLLLLTRKVSGEPPLGDCLIKDCNFSDLDICTIIPHLSTWDQRKKQLLGCLIDSGALPDGLQESQERPVVTCLKHEDFELAFLLLTKGADPRAISLTEGDTPLHAALHIFLEIKADIGFSFLSHLLDLFWSNPTEFDYLNPNVQDSNGNTLMHILFQKGMLKRVKKLLDLLVKFDINFNLKNKEGKDARHRIKKNDSLLLAWNKALMENRRRSRQDSAAHLGKLSKSTAPGHTSQLKSQGSFKSVPCGATARTLPEGSAVPDSWETLPGTQVTRKEPGALRPCSLRDCLMQDITVLIQQVEVDPSFPEDCLQSSEPLEAGAGKEGKKDDKPTLGAGAPDCSEVGEGHAQVGLGALQLVPDDNRGKEGNDDQDDWSTQEIEACLQDFDNMTWEIECTSEMLKKLSSKVMTKVIKKKIILAIQQLGNGEWTQGLQKRLKHLKGSIQLFEAKLDKGARMLWELAIDFSPRCSENPEKIIATEQNTCAMEKSGRIYTEIIRIWDIVLDHCKLADSIKAICNAYNRGLSCVLRKKLKGINKGQVSANMKIQKRIPRCYVEDTEAEKGREHVNPEYFPPASAVETEYNIMKFHSFSTNMAFNILNDTTATVEYPFRVGELEYAVIDLNPRPLEPIILIGRSGTGKTTCCLYRLWKKFHVYWEKAEQAGSPLLAKQVWLKRRLEVEPGKESPGGEEEEEEEDEEEEDSIEVETVESIDEQEYEACAGGAGVEPAGDGQAAEVCAPEHPHQLEHLHQIFVTKNHVLCQEVQRNFIELSKSTKATSHYKPLDPNIHKLQDLRDENFPLFVTSKQLLLLLDASLPKPFFLRNEDGSLKRTIIGWSAQEESTIPSWQEDEEEAEVDGDYSEEDKAVEMRTGDSDPRVYVTFEVFKNEIWPKMTKGRTAYNPALIWKEIKSFLKGSFEALSCPHGRLTEEVYKKLGRKRCPNFKEDRSEIYSLFSLYQQIRSQKGYFDEEDVLYNISRRLSKLRVLPWSIHELYGDEIQDFTQAELALLMKCINDPNSMFLTGDTAQSIMKGVAFRFSDLRSLFHYASRNTIDKQCAVRKPKKIHQLYQNYRSHSGILNLASGVVDLLQFYFPESFDRLPRDSGLFDGPKPTVLESCSVSDLAILLRGNKRKTQPIEFGAHQVILVANETAKEKIPEELGLALVLTIYEAKGLEFDDVLLYNFFTDSEAYKEWKIISSFTPTSTDSREENRPLVEVPLDKPGSSQGRSLMVNPEMYKLLNGELKQLYTAITRARVNLWIFDENREKRAPAFKYFIRRDFVQVVKTDENKDFDDSMFVKTSTPAEWIAQGDYYAKHQCWKVAAKCYQKGGAFEKEKLALAHDTALSMKSKKVSPKEKQLEYLELAKTYLECKEPTLSLKCLSYAKEFQLSAQLCERLGKIRDAAYFYKRSQCYKDAFRCFEQIQEFDLALKMYCQEELFEEAAIAVEKYEEMLKTKTLPISKLSYSASQFYLEAAAKYLSANKMKEMMAVLSKLDIEDQLVFLKSRKRLAEAADLLNREGRREEAALLMKQHGCLLEAARLTADKDFQASCLLGAARLNVARDSDIEHTKDILREALDICYQTGQLSGIAEAHFLQGVILRDFQKLRDAFFKFDTLNHSAGVVEALYEAASQCEAEPEKILGLAPGGLEILLSLVRALKRVTNNAEKEMVKSCFEFFGISQVDAKYCQIAQNDPGPILRIIFDLDLNLREKKTKDHFLIMTDQVKLALNKHLLGRLCQITRSLLGKTYRGVCMRFIVGLKCEDENCEHFHRPLRRCEAKCLVQSKMNLVAINGLLLEAKKVFPKILAEELKEIDYILSTDMYGLCKSILDVLFPKHFHQRVLSENPMACKEILKPNYKSFRFYRFALKEYIHFLFENESARNRRESTDLWLSAMQAFLLSSNYPEEFEKLLHQEEDNYNRELKALESEKDERGRGRGSRIKGIEGKFGMLAPNRDDENMDKTHLCFIRLLENCIDQFYVYRNPEDYKRLFFRFMNVLIKRCKEPLIPSIGNTVALLEFQFIHCGVVLARLWKNVILCLPKSYIALLHYWEFLFSKKDKELGDVFSIIQEYKPKDVTRAIQDFRFHLSYLAKVLCGYENVNFNVLLDAFSEIDYVVSGEAERTLVLCLVMLVNAEEILQPYCKPLLYRHFREIESRLQLMSMDCPGQVPERLLKVVKRVLVAVNVKSVAEALQDLLFERDEEYLMDCDWRWDPVHTKGSIVRGLYYEEVRLNRLLCLDPVDYFAEPECEFGQDEMDELALEDRDHVLATILSQKQRKASIQRKLRRACLVVSLCISWRRRVGTQMERVREEAREPRAGNFKKADVDRTQCDLCGVKFTRGPENYFSPSKAFEGAASEVAVLSRAELEREECQERNSESYEQHIHLEHHQRQQVAYQKYSEFFHEKVDPAIDEGKLVVQDIEQSVWIHSHVGSKEHSHMLQKVQEHIKRVSDMVEDLYRRKAWAGAEEAMTRLVNILILSVRDARDWLMKTETRLKKEGIVQEDDYENEVEDFGELRPRRRSRKCGKQRKY

SEQ ID NO: 87993 - protein, 137 aa, Homo sapiens
  Payload ID: 17621
  Gene Name: tetratricopeptide repeat and ankyrin repeat containing 1
  ENSP ID: ENSP00000485569
MDLTAYAELLKESGNQVLKNGNFSLAIRKYDEAIQILLQLYQWGVPPRDLAVLLCNKSNAFFSLGKWNEAFVAAKECLQWDPTYVKGYYRAGYSLLRLHQPYEAARMFFEGLRLVQRSQDQAPVADFLVGVFTTMSS

SEQ ID NO: 87994 - protein, 292 aa, Homo sapiens
  Payload ID: 17622
  Gene Name: tetratricopeptide repeat domain 1
  Uniprot ID: Q99614
  ENSP ID: ENSP00000231238
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 87995 - protein, 163 aa, Homo sapiens
  Payload ID: 17622
  Gene Name: tetratricopeptide repeat domain 1
  ENSP ID: ENSP00000428613
DKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSWCLCSWCPRFWLSYVQEEAHLLRLTFLIIHTHSPAKASPEPNKPVGWETAQT

SEQ ID NO: 87996 - protein, 292 aa, Homo sapiens; identical to SEQ ID NO: 87994
  Payload ID: 17622
  Gene Name: tetratricopeptide repeat domain 1
  Uniprot ID: Q99614
  ENSP ID: ENSP00000429225

SEQ ID NO: 87997 - protein, 732 aa, Homo sapiens
  Payload ID: 17623
  Gene Name: tetratricopeptide repeat domain 12
  Uniprot ID: Q9H892
  ENSP ID: ENSP00000315160
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRVPAESSHLQFGRESAAPEALSPRRWEEMFHMLVFSLSSVDPPPPPPQTCYP

SEQ ID NO: 87998 - protein, 669 aa, Homo sapiens
  Payload ID: 17623
  Gene Name: tetratricopeptide repeat domain 12
  ENSP ID: ENSP00000376743
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKRAPTPPLETRLVPGNQSLLVQQAEELGFSILKRMWPGWNSITILKPQQRWQNSLGPHPSGCVYQ

SEQ ID NO: 87999 - protein, 202 aa, Homo sapiens
  Payload ID: 17623
  Gene Name: tetratricopeptide repeat domain 12
  ENSP ID: ENSP00000400039
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILE

SEQ ID NO: 88000 - protein, 167 aa, Homo sapiens
  Payload ID: 17623
  Gene Name: tetratricopeptide repeat domain 12
  ENSP ID: ENSP00000402004
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWAL

SEQ ID NO: 88001 - protein, 107 aa, Homo sapiens
  Payload ID: 17623
  Gene Name: tetratricopeptide repeat domain 12
  ENSP ID: ENSP00000413335
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLAD

SEQ ID NO: 88002 - protein, 711 aa, Homo sapiens
  Payload ID: 17623
  Gene Name: tetratricopeptide repeat domain 12
  ENSP ID: ENSP00000419652
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKSFSFMQCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 88003 - protein, 181 aa, Homo sapiens
  Payload ID: 17623
  Gene Name: tetratricopeptide repeat domain 12
  ENSP ID: ENSP00000431806
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQCDEKCTKAYFHMGKANLALKNYSVSRECYKKIL

SEQ ID NO: 88004 - protein, 84 aa, Homo sapiens
  Payload ID: 17623
  Gene Name: tetratricopeptide repeat domain 12
  ENSP ID: ENSP00000433274
  MOD_RES (1)..(1): Any amino acid
XKDMKVLYTNRAQAYMKLEDYEKALVDCEWALKCDEKCTKAYFHMGKANLALKNYSVSRECYKKILEINPKLQTQVFSLHSQAF

SEQ ID NO: 88005 - protein, 705 aa, Homo sapiens
  Payload ID: 17623
  Gene Name: tetratricopeptide repeat domain 12
  Uniprot ID: Q9H892
  ENSP ID: ENSP00000433757
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 88006 - protein, 171 aa, Homo sapiens
  Payload ID: 17623
  Gene Name: tetratricopeptide repeat domain 12
  ENSP ID: ENSP00000433916
MNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSREC

SEQ ID NO: 88007 - protein, 732 aa, Homo sapiens; identical to SEQ ID NO: 87997
  Payload ID: 17623
  Gene Name: tetratricopeptide repeat domain 12
  Uniprot ID: Q9H892
  ENSP ID: ENSP00000435291

SEQ ID NO: 88008 - protein, 254 aa, Homo sapiens
  Payload ID: 17623
  Gene Name: tetratricopeptide repeat domain 12
  ENSP ID: ENSP00000435308
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIR

SEQ ID NO: 88009 - protein, 82 aa, Homo sapiens
  Payload ID: 17623
  Gene Name: tetratricopeptide repeat domain 12
  ENSP ID: ENSP00000435730
EEALRAGVVKKMMKFLKTGGETASRYAIKILAICTNSYHEAREEVIRLDKKCLPRAVISNLEESLLHLKLCLLAGGKRCFTC

SEQ ID NO: 88010 - protein, 89 aa, Homo sapiens
  Payload ID: 17623
  Gene Name: tetratricopeptide repeat domain 12
  ENSP ID: ENSP00000436677
MLIKRKICRNFLKMWMKSSRECYKKILEINPKLQTQVKGYLNQVDLQEKADLQEKEAHELLDSGKNTAVTTKNLLETLSKPDQIPLFYA

SEQ ID NO: 88011 - protein, 150 aa, Homo sapiens
  Payload ID: 17623
  Gene Name: tetratricopeptide repeat domain 12
  ENSP ID: ENSP00000437030
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQQW

SEQ ID NO: 88012 - protein, 860 aa, Homo sapiens
  Payload ID: 17624
  Gene Name: tetratricopeptide repeat domain 13
  Uniprot ID: Q8NBP0
  ENSP ID: ENSP00000355621
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 88013 - protein, 806 aa, Homo sapiens
  Payload ID: 17624
  Gene Name: tetratricopeptide repeat domain 13
  Uniprot ID: Q8NBP0
  ENSP ID: ENSP00000355622
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 88014 - protein, 123 aa, Homo sapiens
  Payload ID: 17624
  Gene Name: tetratricopeptide repeat domain 13
  ENSP ID: ENSP00000428447
DIAVKWRRIADPDQPVLWLDQMPARSLSRGFNNHINLIRGQVINMRYLEYFEKILHFIKDRILVYHGANNPKGLLEVREALEKVHKVEDLLPIMKVTLASEWQSMFLEEKKTNSTFLKRTQNY

SEQ ID NO: 88015 - protein, 166 aa, Homo sapiens
  Payload ID: 17624
  Gene Name: tetratricopeptide repeat domain 13
  ENSP ID: ENSP00000428622
MAPAGCCCCCCFWGGAVAAAGAARRVLLLLLLGVLSAGLRPGALATEHYSPLSLLKQELQHRQQQEAPAGGGGCSPQSGDWGDQYSAECGAIAYVLIGSGLYDEAIRHFSTMLQILSPLGRINEAVNDLTKAIQLQPSARLYRHRGTLYFISEDYATAHEDFQQSL

SEQ ID NO: 88016 - protein, 255 aa, Homo sapiens
  Payload ID: 17624
  Gene Name: tetratricopeptide repeat domain 13
  ENSP ID: ENSP00000430280
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQILSPLGRINEAVNDLTKAIQLQPSARLYRHRGTLYFISENEVESCAVIRQEPRNQRLLKAEEKSDFEELWRPSMLKLLNPSKKL

SEQ ID NO: 88017 - protein, 186 aa, Homo sapiens
  Payload ID: 17624
  Gene Name: tetratricopeptide repeat domain 13
  ENSP ID: ENSP00000430385
  MOD_RES (1)..(1): Any amino acid
XWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQEAIESFKEALKQKVDFIDAYKSLGQA

SEQ ID NO: 88018 - protein, 150 aa, Homo sapiens
  Payload ID: 17624
  Gene Name: tetratricopeptide repeat domain 13
  ENSP ID: ENSP00000431120
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELDIY

SEQ ID NO: 88019 - protein, 770 aa, Homo sapiens
  Payload ID: 17625
  Gene Name: tetratricopeptide repeat domain 14
  Uniprot ID: Q96N46
  ENSP ID: ENSP00000296015
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGGRSEDPRDFYNSYKTQAGSSKTEKPYKSERHFSSRRNSSDSFCRNSEDKIYGYRRFEKDIEGRKEHYRRWEPGSVRHSTSPASSEYSWKSVEKYKKYAHSGSRDFSRHEQRYRLNTNQGEYEREDNYGEDIKTEVPEEDALSSKEHSESSVKKNLPQNLLNIFNQIAEFEKEKGNKSKN

SEQ ID NO: 88020 - protein, 653 aa, Homo sapiens
  Payload ID: 17625
  Gene Name: tetratricopeptide repeat domain 14
  Uniprot ID: Q96N46
  ENSP ID: ENSP00000372027
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGVYSYLFKKLTIKQPQAGPSGDIPEEGIVIIDDSSIHVTDPEDLQVGQDMEVEDSGIDDPDHG

SEQ ID NO: 88021 - protein, 439 aa, Homo sapiens
  Payload ID: 17625
  Gene Name: tetratricopeptide repeat domain 14
  Uniprot ID: Q96N46
  ENSP ID: ENSP00000413743
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQVIPYFLLEI

SEQ ID NO: 88022 - protein, 133 aa, Homo sapiens
  Payload ID: 17625
  Gene Name: tetratricopeptide repeat domain 14
  ENSP ID: ENSP00000417415
MPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYY

SEQ ID NO: 88023 - protein, 185 aa, Homo sapiens
  Payload ID: 17625
  Gene Name: tetratricopeptide repeat domain 14
  ENSP ID: ENSP00000418126
MPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQ

SEQ ID NO: 88024 - protein, 439 aa, Homo sapiens; identical to SEQ ID NO: 88021
  Payload ID: 17625
  Gene Name: tetratricopeptide repeat domain 14
  Uniprot ID: Q96N46
  ENSP ID: ENSP00000419562

SEQ ID NO: 88025 - protein, 192 aa, Homo sapiens
  Payload ID: 17625
  Gene Name: tetratricopeptide repeat domain 14
  ENSP ID: ENSP00000420278
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRGD

SEQ ID NO: 88026 - protein, 176 aa, Homo sapiens
  Payload ID: 17625
  Gene Name: tetratricopeptide repeat domain 14
  ENSP ID: ENSP00000420652
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITVVQLLAVSYQTTKI

SEQ ID NO: 88027 - protein, 175 aa, Homo sapiens
  Payload ID: 17625
  Gene Name: tetratricopeptide repeat domain 14
  ENSP ID: ENSP00000420732
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITVSYFCYLDCFCFC

SEQ ID NO: 88028 - protein, 873 aa, Homo sapiens
  Payload ID: 17626
  Gene Name: tetratricopeptide repeat domain 16
  Uniprot ID: Q8NEE8
  ENSP ID: ENSP00000362386
MTDSDEDALKVDQGPSRDIPKPWVIPAPKGILQHIFGTSHVFQSICDVKPKVTGLTVPLKVREYYSRGQQCLEQADWETAVLLFSRALHLDPQLVDFYALRAEAYLQLCDFSSAAQNLRRAYSLQQDNCKHLERLTFVLYLQGQCLFEQCAFLDALNVFSHAAELQPEKPCFRYRCMACLLALKQHQACLTLITNELKQDTTNADVYIFRARLYNFLQKPHLCYRDLHSALLLNPKHPQARMLLQKMVAQAQQARQDAGILAVQGKLQHALQRINRAIENNPLDPSLFLFRGTMYRRLQEFDGAVEDFLKVLDMVTEDQEDMVRQAQRQLLLTYNDFAVHCYRQGAYQEGVLLLNKALRDEQQEKGLYINRGDCFFQLGNLAFAEADYQQALALSPQDEGANTRMGLLQEKMGFCEQRRKQFQKAENHFSTAIRHNPQKAQYYLYRAKSRQLLQNIFGARQDVATVLLLNPKQPKLSLLMTNLFPGMSVEEVLSTQIAHLARLQLEQMVEGSLQAGSPQGIVGMLKRHELERQKALALQHSWKQGEPLIATSEELKATPEIPQVKPGSSEGEAEAPEEEEEKEKEKKEEKKSELIPSKVASLSDSYLDQTSSASSMSFRTTGTSETEMSAICQEYRSTSATAVTFSDSSLLKTQSSDSGNNREALSHGPRKIKATQGQRQSLSKTEPTQSQRRNSSKTKATIHKRNSSKTKATQSQRRNSSKTRATQGQGQSSSKTEATQGQRQSSSEIEATQGPRQEPSKTKTTRSPRQRPRKVKAARGRSWRPSKVDATQGRSRGLLRSSTKTEAFYDSNWSLSKTEYAQGQGQRSSKAEGAQGKSQGMSSTSSKAESTWGPSPSLSKTEVDQDLTYYEAV

SEQ ID NO: 88029 - protein, 1141 aa, Homo sapiens
  Payload ID: 17627
  Gene Name: tetratricopeptide repeat domain 17
  Uniprot ID: Q96AE7
  ENSP ID: ENSP00000039989
MAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 88030 - protein, 956 aa, Homo sapiens
  Payload ID: 17627
  Gene Name: tetratricopeptide repeat domain 17
  Uniprot ID: Q96AE7
  ENSP ID: ENSP00000299240
MAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGLLDWKTRKVP

SEQ ID NO: 88031 - protein, 172 aa, Homo sapiens
  Payload ID: 17627
  Gene Name: tetratricopeptide repeat domain 17
  ENSP ID: ENSP00000407314
  MOD_RES (1)..(1): Any amino acid
XVLQNLGKDQYPQQSLEQIGTRIAKVLEKASTAGLGMYPYQNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 88032 - protein, 54 aa, Homo sapiens
  Payload ID: 17627
  Gene Name: tetratricopeptide repeat domain 17
  ENSP ID: ENSP00000432900
MAAAVGVRGRYELPPCSGPGWLLSLSALLSVAARGAFATTHWVVTEDGKIQQQL

SEQ ID NO: 88033 - protein, 140 aa, Homo sapiens
  Payload ID: 17627
  Gene Name: tetratricopeptide repeat domain 17
  ENSP ID: ENSP00000473320
  MOD_RES (1)..(1): Any amino acid
XGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQVFFLVQSNSYKRLLYKDFLKL

SEQ ID NO: 88034 - protein, 380 aa, Homo sapiens
  Payload ID: 17628
  Gene Name: tetratricopeptide repeat domain 19
  Uniprot ID: Q6DKK2
  ENSP ID: ENSP00000261647
MFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 88035 - protein, 149 aa, Homo sapiens
  Payload ID: 17628
  Gene Name: tetratricopeptide repeat domain 19
  ENSP ID: ENSP00000465082
GRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLINW

SEQ ID NO: 88036 - protein, 99 aa, Homo sapiens
  Payload ID: 17628
  Gene Name: tetratricopeptide repeat domain 19
  ENSP ID: ENSP00000465627
SKQPSQAQRMYEKALQISEEIQGERHPQTIVLMSDLATTLDAQGRFDEAYIYMQRASDLARQINHPELHMVLSNLAAVLMHRAATTVLGPSKEAKATLG

SEQ ID NO: 88037 - protein, 166 aa, Homo sapiens
  Payload ID: 17628
  Gene Name: tetratricopeptide repeat domain 19
  ENSP ID: ENSP00000465754
  MOD_RES (1)..(1): Any amino acid
XQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKVRRLRALRPAERGSLCERGLGVAAHYSLRLAEEWMEAPRVKLPRMS

SEQ ID NO: 88038 - protein, 172 aa, Homo sapiens
  Payload ID: 17628
  Gene Name: tetratricopeptide repeat domain 19
  ENSP ID: ENSP00000466261
  MOD_RES (1)..(1): Any amino acid
XRRVVGGQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKVRRLRALRPAERGSLCERGLGVAAHYSLRLAEEWMEAPRVKLPRMS

SEQ ID NO: 88039 - protein, 63 aa, Homo sapiens
  Payload ID: 17628
  Gene Name: tetratricopeptide repeat domain 19
  ENSP ID: ENSP00000468372
  MOD_RES (1)..(1): Any amino acid
XGERHPQTIVLMSDLATTLDAQGRFDEAYIYMQRASDLARQINHPELHMVLSNLAAVLMHRGR

SEQ ID NO: 88040 - protein, 110 aa, Homo sapiens
  Payload ID: 17629
  Gene Name: tetratricopeptide repeat domain 21A
  ENSP ID: ENSP00000395118
MSSNDSSLMAGIIYYSQEKYFHHVQQAAAVGLEKFSNDPVLKFFKAYGVLKEGNVLHDAAELLRGPGGGEPDHCDFRELPASPRPEDAAVLSSAGLGADSRNGTQNPRKR

SEQ ID NO: 88041 - protein, 1320 aa, Homo sapiens
  Payload ID: 17629
  Gene Name: tetratricopeptide repeat domain 21A
  Uniprot ID: Q8NDW8
  ENSP ID: ENSP00000398211
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWVDLTSDKPHTAKKAIEYLEQGIQDTKDVLGLMGKAMYFMMQQNYSEALEVVNQITVTSGSFLPALVLKMQLFLARQDWEQTVEMGHRILEKDESNIDACQILTVHELAREGNMTTVSSLKTQKATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEAEYRLEFLKEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARRSLRP

SEQ ID NO: 88042 - protein, 1143 aa, Homo sapiens
  Payload ID: 17629
  Gene Name: tetratricopeptide repeat domain 21A
  ENSP ID: ENSP00000405396
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWVDLTSDKPHTAKKAIEYLEQGIQDTKDVLGLMGKAMYFMMQQNYSEALEVVNQITVTSGSFLPALVLKMQLFLARQDWEQTVEMGHRILEKDESNIDACQILTVHELAREGNMTTATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEAEYRLEFLKEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSGELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLQGQRPCPAGLGTSLRVPEADPQGAYAVEAPGQDPLGAE

SEQ ID NO: 88043 - protein, 128 aa, Homo sapiens
  Payload ID: 17629
  Gene Name: tetratricopeptide repeat domain 21A
  ENSP ID: ENSP00000409299
MSSNDSSLMAGIIYYSQEKYFHHVQQAAAVGLEKFSNDPVLKFFKAYGVLKEEHIQDAISDLESIRHHPDVSLCSTMALIYAHKRCEIIGECHHAQPGLTHQGKESPAPEITQPLKGCQRRPRSNSGA

SEQ ID NO: 88044 - protein, 1272 aa, Homo sapiens
  Payload ID: 17629
  Gene Name: tetratricopeptide repeat domain 21A
  Uniprot ID: Q8NDW8
  ENSP ID: ENSP00000410882
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAMYFMMQQNYSEALEVVNQITVTSGSFLPALVLKMQLFLARQDWEQTVEMGHRILEKDESNIDACQILTVHELAREGNMTTATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEAEYRLEFLKEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSGELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARRSLRP

SEQ ID NO: 88045 - protein, 1316 aa, Homo sapiens
  Payload ID: 17630
  Gene Name: tetratricopeptide repeat domain 21B
  Uniprot ID: Q7Z4L5
  ENSP ID: ENSP00000243344
MDSQELKTLINYYCQERYFHHVLLVASEGIKRYGSDPVFRFYHAYGTLMEGKTQEALREFEAIKNKQDVSLCSLLALIYAHKMSPNPDREAILESDARVKEQRKGAGEKALYHAGLFLWHIGRHDKAREYIDRMIKISDGSKQGHVLKAWLDITRGKEPYTKKALKYFEEGLQDGNDTFALLGKAQCLEMRQNYSGALETVNQIIVNFPSFLPAFVKKMKLQLALQDWDQTVETAQRLLLQDSQNVEALRMQALYYVCREGDIEKASTKLENLGNTLDAMEPQNAQLFYNITLAFSRTCGRSQLILQKIQTLLERAFSLNPQQSEFATELGYQMILQGRVKEALKWYKTAMTLDETSVSALVGFIQCQLIEGQLQDADQQLEFLNEIQQSIGKSAELIYLHAVLAMKKNKRQEEVINLLNDVLDTHFSQLEGLPLGIQYFEKLNPDFLLEIVMEYLSFCPMQPASPGQPLCPLLRRCISVLETVVRTVPGLLQTVFLIAKVKYLSGDIEAAFNNLQHCLEHNPSYADAHLLLAQVYLSQEKVKLCSQSLELCLSYDFKVRDYPLYHLIKAQSQKKMGEIADAIKTLHMAMSLPGMKRIGASTKSKDRKTEVDTSHRLSIFLELIDVHRLNGEQHEATKVLQDAIHEFSGTSEEVRVTIANADLALAQGDIERALSILQNVTAEQPYFIEAREKMADIYLKHRKDKMLYITCFREIAERMANPRSFLLLGDAYMNILEPEEAIVAYEQALNQNPKDGTLASKMGKALIKTHNYSMAITYYEAALKTGQKNYLCYDLAELLLKLKWYDKAEKVLQHALAHEPVNELSALMEDGRCQVLLAKVYSKMEKLGDAITALQQARELQARVLKRVQMEQPDAVPAQKHLAAEICAEIAKHSVAQRDYEKAIKFYREALVHCETDNKIMLELARLYLAQDDPDSCLRQCALLLQSDQDNEAATMMMADLMFRKQDYEQAVFHLQQLLERKPDNYMTLSRLIDLLRRCGKLEDVPRFFSMAEKRNSRAKLEPGFQYCKGLYLWYTGEPNDALRHFNKARKDRDWGQNALYNMIEICLNPDNETVGGEVFENLDGDLGNSTEKQESVQLAVRTAEKLLKELKPQTVQGHVQLRIMENYCLMATKQKSNVEQALNTFTEIAASEKEHIPALLGMATAYMILKQTPRARNQLKRIAKMNWNAIDAEEFEKSWLLLADIYIQSAKYDMAEDLLKRCLRHNRSCCKAYEYMGYIMEKEQAYTDAALNYEMAWKYSNRTNPAVGYKLAFNYLKAKRYVDSIDICHQVLEAHPTYPKIRKDILDKARASLRP

SEQ ID NO: 88046 - protein, 283 aa, Homo sapiens
  Payload ID: 17630
  Gene Name: tetratricopeptide repeat domain 21B
  ENSP ID: ENSP00000376460
  MOD_RES (1)..(1): Any amino acid
XYTGEPNDALRHFNKARKDRDWGQNALYNMIEICLNPDNETVGGEVFENLDGDLGNSTEKQESVQLAVRTAEKLLKELKPQTVQGHVQLRIMENYCLMATKQKSNVEQALNTFTEIAASEKEHIPALLGMATAYMILKQTPRARNQLKRIAKMNWNAIDAEEFEKSWLLLADIYIQSAKYDMAEDLLKRCLRHNRSCCKAYEYMGYIMEKEQAYTDAALNYEMAWKYSNRTNPAVGYKLAFNYLKAKRYVDSIDICHQVLEAHPTYPKIRKDILDKARASLRP

SEQ ID NO: 88047 - protein, 372 aa, Homo sapiens
  Payload ID: 17631
  Gene Name: tetratricopeptide repeat domain 22
  Uniprot ID: Q5TAA0
  ENSP ID: ENSP00000360321
MAELEAVADDLDALIDDLDYLPGHFHLEMQLNFEPRSPAPQRARDLKLQREGLRQELQLAAAPQRPAVRHLLGAFAFYLEELDEARECFLEVAHEHPGNLNAWANLAHVYGRLGQEEEEEACAARLADLMGLAEEPEAAGDPQLRAARCLAEQGYAHGFDVGCASPEERARGLAAGIALYDKALGYGQQIPMEEKRGWYFTMATLYIRLDGIFLELGSEEQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKRRGLTMLPRLVSNSWAQAVLPPRPPKVLEFQV

SEQ ID NO: 88048 - protein, 569 aa, Homo sapiens
  Payload ID: 17631
  Gene Name: tetratricopeptide repeat domain 22
  Uniprot ID: Q5TAA0
  ENSP ID: ENSP00000360323
MAELEAVADDLDALIDDLDYLPGHFHLEMQLNFEPRSPAPQRARDLKLQREGLRQELQLAAAPQRPAVRHLLGAFAFYLEELDEARECFLEVAHEHPGNLNAWANLAHVYGRLGQEEEEEACAARLADLMGLAEEPEAAGDPQLRAARCLAEQGYAHGFDVGCASPEERARGLAAGIALYDKALGYGQQIPMEEKRGWYFTMATLYIRLDGIFLELGSEEQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKIHIRAYLHDLKRAKMGLGGMPDRNHLACAKADLEEVVRVCPGFKAYLDIGQVYYYMGVDAVQELLAVDEAALNQALVFLAKAGESELGATLPELQLLRGKCLRIKGEDANAAACFKRAVELDDAGSSHTDGFGCLLEALLAQWSQAQLSDGELGREVDAWLRRAQDKYPAARLRQELQRVWRGHTDEVLGLARALVAQGRPALVRLLFETMEREGEGASAPRDRRAVSF

SEQ ID NO: 88049 - protein, 170 aa, Homo sapiens
  Payload ID: 17631
  Gene Name: tetratricopeptide repeat domain 22
  ENSP ID: ENSP00000390300
EQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKLPALVPDLPPRAHTEPMCLRKPTRSSQFTSLQAEESSHPLIFSTTIHMT

SEQ ID NO: 88050 - protein, 393 aa, Homo sapiens
  Payload ID: 17632
  Gene Name: tetratricopeptide repeat domain 23
  Uniprot ID: Q5W5X9
  ENSP ID: ENSP00000262074
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKGDLSFLLSATLP

SEQ ID NO: 88051 - protein, 447 aa, Homo sapiens
  Payload ID: 17632
  Gene Name: tetratricopeptide repeat domain 23
  Uniprot ID: Q5W5X9
  ENSP ID: ENSP00000377690
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKCLQIQTLLYGPQDKRTLATQQAMGMLSTAPKVASKPRQASKAKVAFCTSIPQDTLLGKARPGTTAD

SEQ ID NO: 88052 - protein, 447 aa, Homo sapiens; identical to SEQ ID NO: 88051
  Payload ID: 17632
  Gene Name: tetratricopeptide repeat domain 23
  Uniprot ID: Q5W5X9
  ENSP ID: ENSP00000377692

SEQ ID NO: 88053 - protein, 263 aa, Homo sapiens
  Payload ID: 17632
  Gene Name: tetratricopeptide repeat domain 23
  ENSP ID: ENSP00000389470
  MOD_RES (1)..(1): Any amino acid
XVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKAITRATFKNRNWSPSSDPSEHPNQRSVTRRHPRSMLIPSQQGLRMRSSFSHSRETLVSCSQRHFHSLMIAAWCSTVSPDPDPLIWTAGQKDSGHPAGHGHAVHGPQGCFEAKAGIKSQSGLLHQHPSGHPAGEGPARHNSRLRPPP

SEQ ID NO: 88054 - protein, 393 aa, Homo sapiens; identical to SEQ ID NO: 88050
  Payload ID: 17632
  Gene Name: tetratricopeptide repeat domain 23
  Uniprot ID: Q5W5X9
  ENSP ID: ENSP00000433162

SEQ ID NO: 88055 - protein, 73 aa, Homo sapiens
  Payload ID: 17632
  Gene Name: tetratricopeptide repeat domain 23
  ENSP ID: ENSP00000436483
  MOD_RES (1)..(1): Any amino acid
XKRESNLDPERVPGSQSGSIWRFQSRGGRDIPAPGRSRPGAGEPQWGPQETEEESQEKAGSRRFCVTFSGMFC

SEQ ID NO: 88056 - protein, 53 aa, Homo sapiens
  Payload ID: 17632
  Gene Name: tetratricopeptide repeat domain 23
  ENSP ID: ENSP00000452882
MQESQETHISNHLDEVVAAVSITHRKKFQNKLLQTALFQPPREKLHLCEEKAK

SEQ ID NO: 88057 - protein, 447 aa, Homo sapiens; identical to SEQ ID NO: 88051
  Payload ID: 17632
  Gene Name: tetratricopeptide repeat domain 23
  Uniprot ID: Q5W5X9
  ENSP ID: ENSP00000452923

SEQ ID NO: 88058 - protein, 115 aa, Homo sapiens
  Payload ID: 17632
  Gene Name: tetratricopeptide repeat domain 23
  ENSP ID: ENSP00000453419
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKAR

SEQ ID NO: 88059 - protein, 56 aa, Homo sapiens
  Payload ID: 17632
  Gene Name: tetratricopeptide repeat domain 23
  ENSP ID: ENSP00000453673
MQESQETHISNHLDEVVAAVSITHRKKFQNKLLQTALFQPPREKLHLCEEKAKSYS

SEQ ID NO: 88060 - protein, 83 aa, Homo sapiens
  Payload ID: 17632
  Gene Name: tetratricopeptide repeat domain 23
  ENSP ID: ENSP00000453862
MQESQETHISNHLDEVVAAVSITHRKKFQNKLLQTALFQPPREKLHLCEEKAKSYSNSHEYKQAVHELVRCVALTRICYGDSH

SEQ ID NO: 88061 - protein, 151 aa, Homo sapiens
  Payload ID: 17632
  Gene Name: tetratricopeptide repeat domain 23
  ENSP ID: ENSP00000454017
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQ

SEQ ID NO: 88062 - protein, 157 aa, Homo sapiens
  Payload ID: 17632
  Gene Name: tetratricopeptide repeat domain 23
  ENSP ID: ENSP00000454175
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAA

SEQ ID NO: 88063 - protein, 391 aa, Homo sapiens
  Payload ID: 17632
  Gene Name: tetratricopeptide repeat domain 23
  Uniprot ID: Q5W5X9
  ENSP ID: ENSP00000457901
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKVKLEPVLTRD

SEQ ID NO: 88064 - protein, 361 aa, Homo sapiens
  Payload ID: 17633
  Gene Name: tetratricopeptide repeat domain 23-like
  Uniprot ID: Q6PF05
  ENSP ID: ENSP00000422188
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQDK

SEQ ID NO: 88065 - protein, 49 aa, Homo sapiens
  Payload ID: 17633
  Gene Name: tetratricopeptide repeat domain 23-like
  ENSP ID: ENSP00000424418
MQASPIRIPTVSNDIDWDFCFHMPPSSGQETCYISQEYTVDLEGKYDLK

SEQ ID NO: 88066 - protein, 287 aa, Homo sapiens
  Payload ID: 17633
  Gene Name: tetratricopeptide repeat domain 23-like
  Uniprot ID: Q6PF05
  ENSP ID: ENSP00000425242
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQMLLRYIS

SEQ ID NO: 88067 - protein, 287 aa, Homo sapiens; identical to SEQ ID NO: 88066
  Payload ID: 17633
  Gene Name: tetratricopeptide repeat domain 23-like
  Uniprot ID: Q6PF05
  ENSP ID: ENSP00000484792

SEQ ID NO: 88068 - protein, 582 aa, Homo sapiens
  Payload ID: 17634
  Gene Name: tetratricopeptide repeat domain 24
  Uniprot ID: A2A3L6
  ENSP ID: ENSP00000357219
MSSPNPEDVPRRPEPEPSSSNKKKKKRKWLRQEASIQALTRAGHGALQAGQNHEALNNFQRAFLLASKAPQTRDTPVLQACAFNLGAAYVETGDPARGLELLLRAHPEEKAQGRRHGDQCFNVALAYHALGELPQALAWYHRALGHYQPQGDQGEAWAKMGACYQALGQPELAAHCLQEASQAYAQERQLRAAALALGAAAGCMLKSGRHRVGEVVQVLEKSRRLAERSTERRLLGHLYNDLGLGYSQLQLFPLAVEAFLQALPLCWVPGEQATVLRNLGMAHNALGNYQEAREFHQKAADLHGSVGQRWEQGRSFGSLAFALSQLGDHKAARDNYLHALQAARDSGDMKGQWQACEGLGAAAARLGQYDQALKYYKEALAQCQKEPDSVRERLVAKLADTVRTRLAQVGLVQTHTLTSAPGRLQAPGGASQAEGTPAKAGSSTAGVQHRSSSGWEDEEFEEGHQKKKEERSANVPVRAGPGRPELCFLPGTVNHSHHLASSCPTFTKHTPCRGTVLGKASIYSPGPRAHLPFVGPGPPRAEYPSILVPNGPQANRSSRWPRESLSRSRQRRPMESGICTIV

SEQ ID NO: 88069 - protein, 582 aa, Homo sapiens; identical to SEQ ID NO: 88068
  Payload ID: 17634
  Gene Name: tetratricopeptide repeat domain 24
  Uniprot ID: A2A3L6
  ENSP ID: ENSP00000357220

SEQ ID NO: 88070 - protein, 382 aa, Homo sapiens
  Payload ID: 17635
  Gene Name: tetratricopeptide repeat domain 25
  ENSP ID: ENSP00000477931
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDT

SEQ ID NO: 88071 - protein, 672 aa, Homo sapiens
  Payload ID: 17635
  Gene Name: tetratricopeptide repeat domain 25
  Uniprot ID: Q96NG3
  ENSP ID: ENSP00000478589
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKKTGNEMEKEYE

SEQ ID NO: 88072 - protein, 20 aa, Homo sapiens
  Payload ID: 17635
  Gene Name: tetratricopeptide repeat domain 25
  ENSP ID: ENSP00000479460
SLKDAEASLQSDPAFCKVIA

SEQ ID NO: 88073 - protein, 664 aa, Homo sapiens
  Payload ID: 17635
  Gene Name: tetratricopeptide repeat domain 25
  ENSP ID: ENSP00000481958
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKNRK

SEQ ID NO: 88074 - protein, 85 aa, Homo sapiens
  Payload ID: 17635
  Gene Name: tetratricopeptide repeat domain 25
  ENSP ID: ENSP00000484975
MSDPEGETLRSTFPSYMAEGERLYLCGEFSKAAQSFSNALYLQDGDKNCLVARSKCFLKMGDLERSLKDAEASLQSDPAFCKVIA

SEQ ID NO: 88075 - protein, 523 aa, Homo sapiens
  Payload ID: 17636
  Gene Name: tetratricopeptide repeat domain 26
  Uniprot ID: A0AVF1
  ENSP ID: ENSP00000339135
MMLSRAKPAVGRGVQHTDKRKKKGRKIPKLEELLSKRDFTGAITLLEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 88076 - protein, 487 aa, Homo sapiens
  Payload ID: 17636
  Gene Name: tetratricopeptide repeat domain 26
  Uniprot ID: A0AVF1
  ENSP ID: ENSP00000410655
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKRDPSRSAPFTEKHR

SEQ ID NO: 88077 - protein, 423 aa, Homo sapiens
  Payload ID: 17636
  Gene Name: tetratricopeptide repeat domain 26
  ENSP ID: ENSP00000418788
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 88078 - protein, 447 aa, Homo sapiens
  Payload ID: 17636
  Gene Name: tetratricopeptide repeat domain 26
  ENSP ID: ENSP00000419178
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKAELKSLMDNASSSFEFAKELIRHNLVVFRGGEGALQVLPPLVDVIPEARLNLVIYYLRQDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 88079 - protein, 554 aa, Homo sapiens
  Payload ID: 17636
  Gene Name: tetratricopeptide repeat domain 26
  Uniprot ID: A0AVF1
  ENSP ID: ENSP00000419279
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVVFRGGEGALQVLPPLVDVIPEARLNLVIYYLRQDDVQEAYNLIKDLEPTTPQEYILKGVVNAALGQEMGSRDHMKIAQQFFQLVGGSASECDTIPGRQCMASCFFLLKQFDDVLIYLNSFKSYFYNDDIFNFNYAQAKAATGNTSEGEEAFLLIQSEKMKNDYIYLSWLARCYIMNKKPRLAWELYLKMETSGESFSLLQLIANDCYKMGQFYYSAKAFDVLERLDPNPEYWEGKRGACVGIFQMIIAGREPKETLREVLHLLRSTGNTQVEYMIRIMKKWAKENRVSI

SEQ ID NO: 88080 - protein, 135 aa, Homo sapiens
  Payload ID: 17636
  Gene Name: tetratricopeptide repeat domain 26
  ENSP ID: ENSP00000419639
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKEK

SEQ ID NO: 88081 - protein, 271 aa, Homo sapiens
  Payload ID: 17636
  Gene Name: tetratricopeptide repeat domain 26
  ENSP ID: ENSP00000443253
MMLSRAKPAVGRGVQHTDKRKKKGRKIPKLEELLSKRDFTGAITLLEFKRHVGEEEEDTNLWIGYCAFHLGDYKRALEEYENATKEENCNSEVWVNLACTYFFLGMYKQAEAAGFKASKSRLQNRLLFHLAHKFNDEKKLMSFHQNLQDVTEDQLSLASIHYMRSHYQEAIDIYKRILLDNREYLALNVYVALCYYKLDYYDVSQEVLAVYLQQIPDSTIALNLKACNHFRLYNGRAAEAELKSLMDNASSSFEFAKELIRHNLVNNDFPS

SEQ ID NO: 88082 - protein, 843 aa, Homo sapiens
  Payload ID: 17637
  Gene Name: tetratricopeptide repeat domain 27
  Uniprot ID: Q6P3X3
  ENSP ID: ENSP00000313953
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGICTNFQKNNPVHTLTEVELLAFTSCLLSQPKFWAIQTSALILRTKLEKGSTRRVERAMRQTQALADQFEDKTTSVLERLKIFYCCQVPPHWAIQRQLASLLFELGCTSSALQIFEKLEMWEDVVICYERAGQHGKAEEILRQELEKKETPSLYCLLGDVLGDHSCYDKAWELSRYRSARAQRSKALLHLRNKEFQECVECFERSVKINPMQLGVWFSLGCAYLALEDYQGSAKAFQRCVTLEPDNAEAWNNLSTSYIRLKQKVKAFRTLQEALKCNYEHWQIWENYILTSTDVGEFSEAIKAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 88083 - protein, 41 aa, Homo sapiens
  Payload ID: 17637
  Gene Name: tetratricopeptide repeat domain 27
  ENSP ID: ENSP00000392883
MWTPELAILRGFPTEAERQQWKQEGVVGSALIFKRITQCTH

SEQ ID NO: 88084 - protein, 115 aa, Homo sapiens
  Payload ID: 17637
  Gene Name: tetratricopeptide repeat domain 27
  ENSP ID: ENSP00000393327
MTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLAR

SEQ ID NO: 88085 - protein, 46 aa, Homo sapiens
  Payload ID: 17637
  Gene Name: tetratricopeptide repeat domain 27
  ENSP ID: ENSP00000398820
LGVWFSLGCAYLALEDYQGSAKAFQRCVTLEPDVCAYSTVLFTETL

SEQ ID NO: 88086 - protein, 71 aa, Homo sapiens
  Payload ID: 17637
  Gene Name: tetratricopeptide repeat domain 27
  ENSP ID: ENSP00000409230
PVHTLTEVELLAFTSCLLSQPKFWAIQTSALILRTKLEKGSTRRVERAMRQTQVAHDVHLSCHWGCYLIIQ

SEQ ID NO: 88087 - protein, 100 aa, Homo sapiens
  Payload ID: 17637
  Gene Name: tetratricopeptide repeat domain 27
  ENSP ID: ENSP00000410642
  MOD_RES (1)..(1): Any amino acid
XCYERAGQHGKAEEILRQELEKKETPSLYCLLGDVLGDHSCYDKAWELSRYRSARAQRSKALLHLRNKEFQECVECFERSVKINPMQGSGRPEEREKIGE

SEQ ID NO: 88088 - protein, 2481 aa, Homo sapiens
  Payload ID: 17638
  Gene Name: tetratricopeptide repeat domain 28
  Uniprot ID: Q96AY4
  ENSP ID: ENSP00000381003
MEQSPPPAPEPTQGPTPARSRRRREPESPPASAPIPLFGADTIGQRSPDGPVLSKAEFVEKVRQSNQACHDGDFHTAIVLYNEALAVDPQNCILYSNRSAAYMKIQQYDKALDDAIKARLLNPKWPKAYFRQGVALQYLGRHADALAAFASGLAQDPKSLQLLVGMVEAAMKSPMRDSLEPTYQQLQKMKLDKSPFVVVSVVGQELLTAGHHGASVVVLEAALKIGTCSLKLRGSVFSALSSAYWSLGNTEKSTGYMQQDLDVAKTLGDQTGECRAHGNLGSAFFSKGNYREALTNHRHQLVLAMKLKDREAASSALSSLGHVYTAIGDYPNALASHKQCVLLAKQSKDELSEARELGNMGAVYIAMGDFENAVQCHEQHLKIAKDLGNKREEARAYSNLGSAYHYRRNFDKAMSYHNYVLELAQELMEKAIEMRAYAGLGHAARCMQDLERAKQYHEQQLGIAEDLKDRAAEGRASSNLGIIHQMKGDYDTALKLHKTHLCIAQELSDYAAQGRAYGNMGNAYNALGMYDQAVKYHRQELQISMEVNDRASQASTHGNLAVAYQALGAHDRALQHYQNHLNIARELRDIQSEARALSNLGNFHCSRGEYVQAAPYYEQYLRLAPDLQDMEGEGKVCHNLGYAHYCLGNYQEAVKYYEQDLALAKDLHDKLSQAKAYCNLGLAFKALLNFSKAEECQKYLLSLAQSLNNSQAKFRALGNLGDIFICKKDINGAIKFYEQQLGLAHQVKDRRLEASAYAALGTAYRMIQKYDKALGYHTQELEVYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRSCQSMTSLFSNTVSPTQDGTSSLPRRQSSFAKPPLRALYDLLIAPMEGGLMHSSGPVGRHRQLILVLEGELYLIPFALLKGSSSNEYLYERFGLLAVPSIRSLSVQSKSHLRKNPPTYSSSTSMAAVIGNPKLPSAVMDRWLWGPMPSAEEEAYMVSELLGCQPLVGSVATKERVMSALTQAECVHFATHISWKLSALVLTPSMDGNPASSKSSFGHPYTIPESLRVQDDASDGESISDCPPLQELLLTAADVLDLQLPVKLVVLGSSQESNSKVTADGVIALTRAFLAAGAQCVLVSLWPVPVAASKMFIHAFYSSLLNGLKASAALGEAMKVVQSSKAFSHPSNWAGFMLIGSDVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRAVKNMVGMLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 88089 - protein, 108 aa, Homo sapiens
  Payload ID: 17638
  Gene Name: tetratricopeptide repeat domain 28
  ENSP ID: ENSP00000388788
EQHIASVREALGVESHYSRACASSETESEAGDIMDQQFEEMNNKLNSVTDPTGFLRMVRRNNLFNRDATRFAEAWDWAWTHVLALPTSQPVKAGDTYLHQVMQAVVIN

SEQ ID NO: 88090 - protein, 301 aa, Homo sapiens
  Payload ID: 17638
  Gene Name: tetratricopeptide repeat domain 28
  ENSP ID: ENSP00000410244
DVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQD

SEQ ID NO: 88091 - protein, 2354 aa, Homo sapiens
  Payload ID: 17638
  Gene Name: tetratricopeptide repeat domain 28
  ENSP ID: ENSP00000479834
AYFRQGVALQYLGRHADALAAFASGLAQDPKSLQLLVGMVEAAMKSPMRDSLEPTYQQLQKMKLDKSPFVVVSVVGQELLTAGHHGASVVVLEAALKIGTCSLKLRGSVFSALSSAYWSLGNTEKSTGYMQQDLDVAKTLGDQTGECRAHGNLGSAFFSKGNYREALTNHRHQLVLAMKLKDREAASSALSSLGHVYTAIGDYPNALASHKQCVLLAKQSKDELSEARELGNMGAVYIAMGDFENAVQCHEQHLKIAKDLGNKREEARAYSNLGSAYHYRRNFDKAMSYHNYVLELAQELMEKAIEMRAYAGLGHAARCMQDLERAKQYHEQQLGIAEDLKDRAAEGRASSNLGIIHQMKGDYDTALKLHKTHLCIAQELSDYAAQGRAYGNMGNAYNALGMYDQAVKYHRQELQISMEVNDRASQASTHGNLAVAYQALGAHDRALQHYQNHLNIARELRDIQSEARALSNLGNFHCSRGEYVQAAPYYEQYLRLAPDLQDMEGEGKVCHNLGYAHYCLGNYQEAVKYYEQDLALAKDLHDKLSQAKAYCNLGLAFKALLNFSKAEECQKYLLSLAQSLNNSQAKFRALGNLGDIFICKKDINGAIKFYEQQLGLAHQVKDRRLEASAYAALGTAYRMIQKYDKALGYHTQELEVYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRSCQSMTSLFSNTVSPTQDGTSSLPRRQSSFAKPPLRALYDLLIAPMEGGLMHSSGPVGRHRQLILVLEGELYLIPFALLKGSSSNEYLYERFGLLAVPSIRSLSVQSKSHLRKNPPTYSSSTSMAAVIGNPKLPSAVMDRWLWGPMPSAEEEAYMVSELLGCQPLVGSVATKERVMSALTQAECVHFATHISWKLSALVLTPSMDGNPASSKSSFGHPYTIPESLRVQDDASDGESISDCPPLQELLLTAADVLDLQLPVKLVVLGSSQESNSKVTADGVIALTRAFLAAGAQCVLVSLWPVPVAASKMFIHAFYSSLLNGLKASAALGEAMKVVQSSKAFSHPSNWAGFMLIGSDVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRAVKNMVGMLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 88092 - protein, 475 aa, Homo sapiens
  Payload ID: 17639
  Gene Name: tetratricopeptide repeat domain 29
  Uniprot ID: Q8NA56
  ENSP ID: ENSP00000316740
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKISTDLDDDLSLGRGYEAIAKVLQSQGEMTEAIKYLKKFVKIARNNFQSLDLVRASTMLGDIYNEKGYYNKASECFQQAFDTTVELMSMPLMDETKVHYGIAKAHQMMLTVNNYIESADLTSLNYLLSWKESRGNIEPDPVTEEFRGSTVEAVSQNSERLEELSRFPGDQKNET

SEQ ID NO: 88093 - protein, 319 aa, Homo sapiens
  Payload ID: 17639
  Gene Name: tetratricopeptide repeat domain 29
  ENSP ID: ENSP00000381861
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKSPQTWMMISVWGEAMKP

SEQ ID NO: 88094 - protein, 363 aa, Homo sapiens
  Payload ID: 17639
  Gene Name: tetratricopeptide repeat domain 29
  ENSP ID: ENSP00000422648
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKISTDLDDDLSLGRGYEAIAKVLQRDMSLSSNNSHLLALLLIWNILASFPGFEFLVDSVKAK

SEQ ID NO: 88095 - protein, 501 aa, Homo sapiens
  Payload ID: 17639
  Gene Name: tetratricopeptide repeat domain 29
  ENSP ID: ENSP00000423505
MIPMFTVTLEDSGTLWKSLHSSSESEMTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKISTDLDDDLSLGRGYEAIAKVLQSQGEMTEAIKYLKKFVKIARNNFQSLDLVRASTMLGDIYNEKGYYNKASECFQQAFDTTVELMSMPLMDETKVHYGIAKAHQMMLTVNNYIESADLTSLNYLLSWKESRGNIEPDPVTEEFRGSTVEAVSQNSERLEELSRFPGDQKNET

SEQ ID NO: 88096 - protein, 93 aa, Homo sapiens
  Payload ID: 17639
  Gene Name: tetratricopeptide repeat domain 29
  ENSP ID: ENSP00000423646
MIPMFTVTLEDSGTLWKSLHSSSESEMTTLPPLPMTRPKLTALARQKLPCSSRKIPRSQLIKEKDDIDHYLEVNFKGLSKEEVAAYRNSYKKN

SEQ ID NO: 88097 - protein, 26 aa, Homo sapiens
  Payload ID: 17639
  Gene Name: tetratricopeptide repeat domain 29
  ENSP ID: ENSP00000425665
MTTLPPLPMTRPKLTALARQKLPCSS

SEQ ID NO: 88098 - protein, 474 aa, Homo sapiens
  Payload ID: 17639
  Gene Name: tetratricopeptide repeat domain 29
  ENSP ID: ENSP00000425778
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVHNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAEASYYLGLAHLAAEEYETALTVLDTYCKISTDLDDDLSLGRGYEAIAKVLQSQGEMTEAIKYLKKFVKIARNNFQSLDLVRASTMLGDIYNEKGYYNKASECFQQAFDTTVELMSMPLMDETKVHYGIAKAHQMMLTVNNYIESADLTSLNYLLSWKESRGNIEPDPVTEFRGSTVEAVSQNSERLEELSRFPGDQKNET

SEQ ID NO: 88099 - protein, 2025 aa, Homo sapiens
  Payload ID: 17640
  Gene Name: tetratricopeptide repeat domain 3
  Uniprot ID: P53804
  ENSP ID: ENSP00000346791
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGDDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 88100 - protein, 2025 aa, Homo sapiens; identical to SEQ ID NO: 88099
  Payload ID: 17640
  Gene Name: tetratricopeptide repeat domain 3
  Uniprot ID: P53804
  ENSP ID: ENSP00000347889

SEQ ID NO: 88101 - protein, 300 aa, Homo sapiens
  Payload ID: 17640
  Gene Name: tetratricopeptide repeat domain 3
  ENSP ID: ENSP00000381974
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRTHSHGRKFGKYKSLKRRK

SEQ ID NO: 88102 - protein, 2025 aa, Homo sapiens; identical to SEQ ID NO: 88099
  Payload ID: 17640
  Gene Name: tetratricopeptide repeat domain 3
  Uniprot ID: P53804
  ENSP ID: ENSP00000381981

SEQ ID NO: 88103 - protein, 298 aa, Homo sapiens
  Payload ID: 17640
  Gene Name: tetratricopeptide repeat domain 3
  ENSP ID: ENSP00000387880
  MOD_RES (1)..(1): Any amino acid
XNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDIFTASWERLHVTLTESINSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEET

SEQ ID NO: 88104 - protein, 1165 aa, Homo sapiens
  Payload ID: 17640
  Gene Name: tetratricopeptide repeat domain 3
  ENSP ID: ENSP00000391891
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVAKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRK

SEQ ID NO: 88105 - protein, 317 aa, Homo sapiens
  Payload ID: 17640
  Gene Name: tetratricopeptide repeat domain 3
  ENSP ID: ENSP00000393681
  MOD_RES (1)..(1): Any amino acid
XDPAAYPDMESDIRSWELFLSNVTKEIEKAKVHPELLPESSGDDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 88106 - protein, 1179 aa, Homo sapiens
  Payload ID: 17640
  Gene Name: tetratricopeptide repeat domain 3
  ENSP ID: ENSP00000403943
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLK

SEQ ID NO: 88107 - protein, 780 aa, Homo sapiens
  Payload ID: 17640
  Gene Name: tetratricopeptide repeat domain 3
  ENSP ID: ENSP00000408456
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEA

SEQ ID NO: 88108 - protein, 277 aa, Homo sapiens
  Payload ID: 17640
  Gene Name: tetratricopeptide repeat domain 3
  ENSP ID: ENSP00000414658
  MOD_RES (1)..(1): Any amino acid
XTLIYRLPGVLTWPTSNVIIEESQPQKIKMLLEKFVEECKFPPVPDAICCYQKCHGYSKIQIYITDPDFKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSF

SEQ ID NO: 88109 - protein, 612 aa, Homo sapiens
  Payload ID: 17640
  Gene Name: tetratricopeptide repeat domain 3
  ENSP ID: ENSP00000442875
MLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGMSLYIPEQ

SEQ ID NO: 88110 - protein, 665 aa, Homo sapiens
  Payload ID: 17641
  Gene Name: tetratricopeptide repeat domain 30A
  Uniprot ID: Q86WT1
  ENSP ID: ENSP00000347915
MAGLSGAQIPDGEFTALVYRLIRDARYAEAVQLLGRELQRSPRSRAGLSLLGYCYYRLQEFALAAECYEQLGQLHPELEQYRLYQAQALYKACLYPEATRVAFLLLDNPAYHSRVLRLQAAIKYSEGDLPGSRSLVEQLLSGEGGEESGGDNETDGQVNLGCLLYKEGQYEAACSKFSATLQASGYQPDLSYNLALAYYSSRQYASALKHIAEIIERGIRQHPELGVGMTTEGFDVRSVGNTLVLHQTALVEAFNLKAAIEYQLRNYEVAQETLTDMPPRAEEELDPVTLHNQALMNMDARPTEGFEKLQFLLQQNPFPPETFGNLLLLYCKYEYFDLAADVLAENAHLTYKFLTPYLYDFLDALITCQTAPEEAFIKLDGLAGMLTEQLRRLTKQVQEARHNRDDEAIKKAVNEYDETMEKYIPVLMAQAKIYWNLENYPMVEKVFRKSVEFCNDHDVWKLNVAHVLFMQENKYKEAIGFYEPIVKKHYDNILNVSAIVLANLCVSYIMTSQNEEAEELMRKIEKEEEQLSYDDPNRKMYHLCIVNLVIGTLYCAKGNYEFGISRVIKSLEPYNKKLGTDTWYYAKRCFLSLLENMSKHMIVIHDSVIQECVQFLGHCELYGTNIPAVIEQPLEEERMHVGKNTVTDESRQLKALIYEIIGWNK

SEQ ID NO: 88111 - protein, 665 aa, Homo sapiens
  Payload ID: 17642
  Gene Name: tetratricopeptide repeat domain 30B
  Uniprot ID: Q8N4P2
  ENSP ID: ENSP00000386181
MAGLSGAQIPDGEFTAVVYRLIRNARYAEAVQLLGGELQRSPRSRAGLSLLGYCYYRLQEFALAAECYEQLGQLHPELEQYRLYQAQALYKACLYAEATRVAFLLLDNPAYHSRVLRLQAAIKYSEGDLPGSRSLVEQLPSREGGEESGGENETDGQINLGCLLYKEGQYEAACSKFFAALQASGYQPDLSYNLALAYYSSRQYASALKHIAEIIERGIRQHPELGVGMTTEGIDVRSVGNTLVLHQTALVEAFNLKAAIEYQLRNYEAAQEALTDMPPRAEEELDPVTLHNQALMNMDARPTEGFEKLQFLLQQNPFPPETFGNLLLLYCKYEYFDLAADVLAENAHLIYKFLTPYLYDFLDAVITCQTAPEEAFIKLDGLAGMLTEVLRKLTIQVQEARHNRDDEAIKKAVNEYDETMEKYIPVLMAQAKIYWNLENYPMVEKIFRKSVEFCNDHDVWKLNVAHVLFMQENKYKEAIGFYEPIVKKHYDNILNVSAIVLANLCVSYIMTSQNEEAEELMRKIEKEEEQLSYDDPDKKMYHLCIVNLVIGTLYCAKGNYDFGISRVIKSLEPYNKKLGTDTWYYAKRCFLSLLENMSKHTIMLRDSVIQECVQFLEHCELHGRNIPAVIEQPLEEERMHVGKNTVTYESRQLKALIYEIIGWNI

SEQ ID NO: 88112 - protein, 519 aa, Homo sapiens
  Payload ID: 17643
  Gene Name: tetratricopeptide repeat domain 31
  Uniprot ID: Q49AM3
  ENSP ID: ENSP00000233623
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLQGQRGGICAPPLSPGALQPLPHAELAPSGLPSLRCPRSTALRSPGLSPLLHYPSCHRSHPNQPLSQTQSRRPHPLKPQDPSKGWDILGLGLQHLSQAR

SEQ ID NO: 88113 - protein, 340 aa, Homo sapiens
  Payload ID: 17643
  Gene Name: tetratricopeptide repeat domain 31
  ENSP ID: ENSP00000387213
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHR

SEQ ID NO: 88114 - protein, 246 aa, Homo sapiens
  Payload ID: 17643
  Gene Name: tetratricopeptide repeat domain 31
  ENSP ID: ENSP00000387843
  MOD_RES (1)..(1): Any amino acid
XGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQETLRGGSQPDAARELRSCLLHLTLGQRGGICAPPLSPGALQPLPHAELAPSGLPSLRCPRSTALRSPGLSPLLHYPSCHRSHPNQPLSQTQSRRPHPLKPQDPSKGWDILGLGLQHLSQAR

SEQ ID NO: 88115 - protein, 116 aa, Homo sapiens
  Payload ID: 17643
  Gene Name: tetratricopeptide repeat domain 31
  ENSP ID: ENSP00000388495
MAPIPKTVGRIKLDCSLRPSCPLEVAAAPKLCKEFGPEDYGEEITSWATWMMKGNQLDRVTGARGLRDWAPTVVSASPSCILPKSLSPALKAPLPLPPSPVSQTACFRWPCPRSSW

SEQ ID NO: 88116 - protein, 116 aa, Homo sapiens; identical to SEQ ID NO: 88115
  Payload ID: 17643
  Gene Name: tetratricopeptide repeat domain 31
  ENSP ID: ENSP00000389127

SEQ ID NO: 88117 - protein, 285 aa, Homo sapiens
  Payload ID: 17643
  Gene Name: tetratricopeptide repeat domain 31
  Uniprot ID: Q49AM3
  ENSP ID: ENSP00000416823
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPATSPC

SEQ ID NO: 88118 - protein, 151 aa, Homo sapiens
  Payload ID: 17644
  Gene Name: tetratricopeptide repeat domain 32
  Uniprot ID: Q5I0X7
  ENSP ID: ENSP00000333018
MEGQRQESHATLTLAQAHFNNGEYAEAEALYSAYIRRCACAASSDESPGSKCSPEDLATAYNNRGQIKYFRVDFYEAMDDYTSAIEVQPNFEVPYYNRGLILYRLGYFDDALEDFKKVLDLNPGFQDATLSLKQTILDKEEKQRRNVAKNY

SEQ ID NO: 88119 - protein, 52 aa, Homo sapiens
  Payload ID: 17644
  Gene Name: tetratricopeptide repeat domain 32
  ENSP ID: ENSP00000385708
MEGQRQESHATLTLAQAHFNNGEYAEAEALYSAYIRRCACAASSDESPGRIF

SEQ ID NO: 88120 - protein, 86 aa, Homo sapiens
  Payload ID: 17644
  Gene Name: tetratricopeptide repeat domain 32
  ENSP ID: ENSP00000412874
MDVSEGTTMSSSHSYLISSRQCWNHSDRLISKCSPEDLATAYNNRGQIKYFRVDFYEAMDDYTSAIEVQPNFEVPYYNRGLILYRL

SEQ ID NO: 88121 - protein, 262 aa, Homo sapiens
  Payload ID: 17645
  Gene Name: tetratricopeptide repeat domain 33
  Uniprot ID: Q6PID6
  ENSP ID: ENSP00000338533
MASFGWKRKIGEKVSKVTSQQFEAEAADEKDVVDNDEGNWLHAIKRRKEILLEGCAEKSKQLKDEGASLAENKRYREAIQKWDEALQLTPNDATLYEMKSQVLMSLHEMFPAVHAAEMAVQQNPHSWESWQTLGRAQLGLGEIILAIRSFQVALHIYPMNPEIWKEDLSWARTLQEQQKVAQRIKKSEAPAEVTHFSPKSIPDYDFESDEIVAVCAAIAEKEKTVSANKTMVIVSASGAIETVTEKEDGATPPDGSVFIKAR

SEQ ID NO: 88122 - protein, 566 aa, Homo sapiens
  Payload ID: 17646
  Gene Name: tetratricopeptide repeat domain 34
  Uniprot ID: A8MYJ7
  ENSP ID: ENSP00000383873
MLQRSPRAGPSRAQGRREAAETGGPTTQEGVACGVHQLATLLMELDSEDEASRLLAADALYRLGRLEETHKALLVALSRRPQAAPVLARLALLQLRRGFFYDANQLVKKLVQSGDTACLQPTLDVFCHEDRQLLQGHCHARALAILRARPGGADGRVHTKEAIAYLSLAIFAAGSQASESLLARARCYGFLGQKKTAMFDFNTVLRAEPGNVQALCGRALVHLALDQLQEAVDDIVSALKLGPGTVVPELRSLKPEAQALITQGLYSHCRALLSQLPDTGAPLEDKDTQGLLAVGEALIKIDSGQPHWHLLLADILMAQGSYEEAGTHLEKALHRAPTSEAARARLGLLQLKKGDVPGAARDLQSLAEVDAPDLSCLLHLLEASERQSLAQAAAQEAGTLLDAGQPRQALGYCSLSVLASGSSACHLRLRATCLAELQEFGRALRDLDHVLQEALGDGDLPRRAEDFCRQGRLLLSLGDEAAAAGAFAQALKLAPSLAQNSLCRQPGRAPTARMFLLRGQCCLEEQRHAEAWTAVESGLLVDPDHRGLKRLKARIRREASSGCWLQ

SEQ ID NO: 88123 - protein, 566 aa, Homo sapiens; identical to SEQ ID NO: 88122
  Payload ID: 17646
  Gene Name: tetratricopeptide repeat domain 34
  Uniprot ID: A8MYJ7
  ENSP ID: ENSP00000483029

SEQ ID NO: 88124 - protein, 189 aa, Homo sapiens
  Payload ID: 17647
  Gene Name: tetratricopeptide repeat domain 36
  Uniprot ID: A6NLP5
  ENSP ID: ENSP00000307640
MGTPNDQAVLQAIFNPDTPFGDIVGLDLGEEAEKEEREEDEVFPQAQLEQSKALELQGVMAAEAGDLSTALERFGQAICLLPERASAYNNRAQARRLQGDVAGALEDLERAVELSGGRGRAARQSFVQRGLLARLQGRDDDARRDFERAARLGSPFARRQLVLLNPYAALCNRMLADMMGQLRRPRDSR

SEQ ID NO: 88125 - protein, 48 aa, Homo sapiens
  Payload ID: 17647
  Gene Name: tetratricopeptide repeat domain 36
  ENSP ID: ENSP00000436858
MGTPNDQAVLQAIFNPDTPFGDIVGLDLGEEAEKEEREEENTTTRTED

SEQ ID NO: 88126 - protein, 48 aa, Homo sapiens; identical to SEQ ID NO: 88125
  Payload ID: 17647
  Gene Name: tetratricopeptide repeat domain 36
  ENSP ID: ENSP00000437178

SEQ ID NO: 88127 - protein, 1564 aa, Homo sapiens
  Payload ID: 17648
  Gene Name: tetratricopeptide repeat domain 37
  Uniprot ID: Q6PGP7
  ENSP ID: ENSP00000351596
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRALKLMSTSNTWCDLGINYYRQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 88128 - protein, 33 aa, Homo sapiens
  Payload ID: 17648
  Gene Name: tetratricopeptide repeat domain 37
  ENSP ID: ENSP00000422749
DNIPGLLVLKSLAYRNKGSFDEAAKLKFMPLRL

SEQ ID NO: 88129 - protein, 130 aa, Homo sapiens
  Payload ID: 17648
  Gene Name: tetratricopeptide repeat domain 37
  ENSP ID: ENSP00000423141
TRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNGFSYPNNSNSKGKCWNGKMGLA

SEQ ID NO: 88130 - protein, 611 aa, Homo sapiens
  Payload ID: 17648
  Gene Name: tetratricopeptide repeat domain 37
  ENSP ID: ENSP00000423742
MSSKEVKTALKSARDAIRNKEYKEALKHCKGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMII

SEQ ID NO: 88131 - protein, 95 aa, Homo sapiens
  Payload ID: 17648
  Gene Name: tetratricopeptide repeat domain 37
  ENSP ID: ENSP00000425403
MSSKEVKTALKSARDAIRNKEYKEALKHCKTVLKQEKNNYNAWVFIGVAAAELEQPDQAQSAYKKAAELEPDQLLAWQGLANLYEKYNHINAKDD

SEQ ID NO: 88132 - protein, 469 aa, Homo sapiens
  Payload ID: 17649
  Gene Name: tetratricopeptide repeat domain 38
  Uniprot ID: Q5R3I4
  ENSP ID: ENSP00000370419
MAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETFWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 88133 - protein, 53 aa, Homo sapiens
  Payload ID: 17649
  Gene Name: tetratricopeptide repeat domain 38
  ENSP ID: ENSP00000391236
MAAASPLRDCQAWKDARLPLSTTSNEACKLFDATLTQDSEWWVDSGGCSGDVF

SEQ ID NO: 88134 - protein, 119 aa, Homo sapiens
  Payload ID: 17649
  Gene Name: tetratricopeptide repeat domain 38
  ENSP ID: ENSP00000393531
  MOD_RES (1)..(1): Any amino acid
XFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARGKVSLGHPGWNAVV

SEQ ID NO: 88135 - protein, 209 aa, Homo sapiens
  Payload ID: 17649
  Gene Name: tetratricopeptide repeat domain 38
  ENSP ID: ENSP00000406604
  MOD_RES (1)..(1): Any amino acid
XEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETFWKGLVRRSEQPLQST

SEQ ID NO: 88136 - protein, 263 aa, Homo sapiens
  Payload ID: 17649
  Gene Name: tetratricopeptide repeat domain 38
  ENSP ID: ENSP00000410095
MAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEAPTLCLQHQHPTDNYWAGKAGCDGARSGNTWALCLQPQAGEGRRSQGRSRQAAGTGTA

SEQ ID NO: 88137 - protein, 53 aa, Homo sapiens; identical to SEQ ID NO: 88133
  Payload ID: 17649
  Gene Name: tetratricopeptide repeat domain 38
  ENSP ID: ENSP00000486276

SEQ ID NO: 88138 - protein, 550 aa, Homo sapiens
  Payload ID: 17650
  Gene Name: tetratricopeptide repeat domain 39A
  ENSP ID: ENSP00000262675
MTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 88139 - protein, 420 aa, Homo sapiens
  Payload ID: 17650
  Gene Name: tetratricopeptide repeat domain 39A
  Uniprot ID: Q5SRH9
  ENSP ID: ENSP00000262676
MDSSPSLPLIRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFLLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAVSDGGPGRGWGSLGVSQTSRKSGTCDILRDRIDWGRGGGQERTNQRAGAGEALLAEQPGKTREEEAFVVPGILTGRYRTAALQWREVEGGA

SEQ ID NO: 88140 - protein, 426 aa, Homo sapiens
  Payload ID: 17650
  Gene Name: tetratricopeptide repeat domain 39A
  ENSP ID: ENSP00000360812
MTSAGGAPGALPAGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFLLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRWVPHRAPTV

SEQ ID NO: 88141 - protein, 578 aa, Homo sapiens
  Payload ID: 17650
  Gene Name: tetratricopeptide repeat domain 39A
  Uniprot ID: Q5SRH9
  ENSP ID: ENSP00000360815
MGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 88142 - protein, 188 aa, Homo sapiens
  Payload ID: 17650
  Gene Name: tetratricopeptide repeat domain 39A
  ENSP ID: ENSP00000370230
MTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFLLQDENMVSFIKGGIKVRNSYQTYKELDSLVQSSQYCKGENH

SEQ ID NO: 88143 - protein, 158 aa, Homo sapiens
  Payload ID: 17650
  Gene Name: tetratricopeptide repeat domain 39A
  ENSP ID: ENSP00000383830
MAFLTTWKEAASGKSDRRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRAL

SEQ ID NO: 88144 - protein, 227 aa, Homo sapiens
  Payload ID: 17650
  Gene Name: tetratricopeptide repeat domain 39A
  ENSP ID: ENSP00000388995
MTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVL

SEQ ID NO: 88145 - protein, 613 aa, Homo sapiens
  Payload ID: 17650
  Gene Name: tetratricopeptide repeat domain 39A
  Uniprot ID: Q5SRH9
  ENSP ID: ENSP00000393952
MGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFLLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 88146 - protein, 297 aa, Homo sapiens
  Payload ID: 17650
  Gene Name: tetratricopeptide repeat domain 39A
  ENSP ID: ENSP00000405803
MTSAGGAPGALPAGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDA

SEQ ID NO: 88147 - protein, 581 aa, Homo sapiens
  Payload ID: 17650
  Gene Name: tetratricopeptide repeat domain 39A
  Uniprot ID: Q5SRH9
  ENSP ID: ENSP00000406144
MAFLTTWKEAASGKSDRRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 88148 - protein, 279 aa, Homo sapiens
  Payload ID: 17650
  Gene Name: tetratricopeptide repeat domain 39A
  ENSP ID: ENSP00000408532
MTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECC

SEQ ID NO: 88149 - protein, 221 aa, Homo sapiens
  Payload ID: 17650
  Gene Name: tetratricopeptide repeat domain 39A
  Uniprot ID: Q5SRH9
  ENSP ID: ENSP00000431228
MKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 88150 - protein, 168 aa, Homo sapiens
  Payload ID: 17650
  Gene Name: tetratricopeptide repeat domain 39A
  ENSP ID: ENSP00000432453
MAFLTTWKEAASGKSDRRTFPAWENPVVHRPVGTREPSGSPVTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFL

SEQ ID NO: 88151 - protein, 124 aa, Homo sapiens
  Payload ID: 17650
  Gene Name: tetratricopeptide repeat domain 39A
  ENSP ID: ENSP00000434483
MTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRP

SEQ ID NO: 88152 - protein, 112 aa, Homo sapiens
  Payload ID: 17650
  Gene Name: tetratricopeptide repeat domain 39A
  ENSP ID: ENSP00000436659
MKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDE

SEQ ID NO: 88153 - protein, 613 aa, Homo sapiens
  Payload ID: 17651
  Gene Name: tetratricopeptide repeat domain 39B
  Uniprot ID: Q5VTQ0
  ENSP ID: ENSP00000297615
MDAVLACRLRGRGNRVAALRPRPRPGGSAGPSPFALLCAGLSPEPRAGVGSEFPAWFLGGSSQRRNMALLGSRAELEADEDVFEDALETISMAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 88154 - protein, 669 aa, Homo sapiens
  Payload ID: 17651
  Gene Name: tetratricopeptide repeat domain 39B
  Uniprot ID: Q5VTQ0
  ENSP ID: ENSP00000370231
MDAVLACRLRGRGNRVAALRPRPRPGGSAGPSPFALLCAGLSPEPRAGVGSEFPAWFLGGSSQRRNMALLGSRAELEADEDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNVRSVFQSAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 88155 - protein, 682 aa, Homo sapiens
  Payload ID: 17651
  Gene Name: tetratricopeptide repeat domain 39B
  Uniprot ID: Q5VTQ0
  ENSP ID: ENSP00000422496
MDAVLACRLRGRGNRVAALRPRPRPGGSAGPSPFALLCAGLSPEPRAGVGSEFPAWFLGGSSQRRNMALLGSRAELEADEDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 88156 - protein, 517 aa, Homo sapiens
  Payload ID: 17651
  Gene Name: tetratricopeptide repeat domain 39B
  Uniprot ID: Q5VTQ0
  ENSP ID: ENSP00000423392
MYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 88157 - protein, 517 aa, Homo sapiens; identical to SEQ ID NO: 88156
  Payload ID: 17651
  Gene Name: tetratricopeptide repeat domain 39B
  Uniprot ID: Q5VTQ0
  ENSP ID: ENSP00000426539

SEQ ID NO: 88158 - protein, 69 aa, Homo sapiens
  Payload ID: 17651
  Gene Name: tetratricopeptide repeat domain 39B
  ENSP ID: ENSP00000427314
AGLSPEPRAGVGSEFPAWFLGGSSQRRNMALLGSRAELEADEDVFEDALETISIWLKKKSGRREGKTSS

SEQ ID NO: 88159 - protein, 522 aa, Homo sapiens
  Payload ID: 17652
  Gene Name: tetratricopeptide repeat domain 39C
  Uniprot ID: Q8N584
  ENSP ID: ENSP00000306598
MSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYASESKDMKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 88160 - protein, 583 aa, Homo sapiens
  Payload ID: 17652
  Gene Name: tetratricopeptide repeat domain 39C
  Uniprot ID: Q8N584
  ENSP ID: ENSP00000323645
MAGSEQQRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYASESKDMKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 88161 - protein, 276 aa, Homo sapiens
  Payload ID: 17652
  Gene Name: tetratricopeptide repeat domain 39C
  ENSP ID: ENSP00000443016
MHAPFRISCQVVWLFKIYLLMCQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 88162 - protein, 67 aa, Homo sapiens
  Payload ID: 17652
  Gene Name: tetratricopeptide repeat domain 39C
  ENSP ID: ENSP00000463283
MIELNFKDAFDSFERLKNESRWSQCYYAYLTAVCQGATGDVDGAQIVFKEVQKLFKRKNNQIEQFSV

SEQ ID NO: 88163 - protein, 43 aa, Homo sapiens
  Payload ID: 17652
  Gene Name: tetratricopeptide repeat domain 39C
  ENSP ID: ENSP00000463610
MSGWKTLSQQQQRDAPSKILLCGKSFLTSEKTSALPGETQRRL

SEQ ID NO: 88164 - protein, 76 aa, Homo sapiens
  Payload ID: 17652
  Gene Name: tetratricopeptide repeat domain 39C
  Uniprot ID: Q8N584
  ENSP ID: ENSP00000464344
MAGSEQQRPRRRDDGDSDAAAAAAAPLQDAELALAGINMLLNNGFRESDQLFKQYRKSFLTSEKTSALPGETQRRL

SEQ ID NO: 88165 - protein, 387 aa, Homo sapiens
  Payload ID: 17653
  Gene Name: tetratricopeptide repeat domain 4
  Uniprot ID: O95801
  ENSP ID: ENSP00000360329
MEQPGQDPTSDDVMDSFLEKFQSQPYRGGFHEDQWEKEFEKVPLFMSRAPSEIDPRENPDLACLQSIIFDEERSPEEQAKTYKDEGNDYFKEKDYKKAVISYTEGLKKKCADPDLNAVLYTNRAAAQYYLGNFRSALNDVTAARKLKPCHLKAIIRGALCHLELKHFAEAVNWCDEGLQIDAKEKKLLEMRAKADKLKRIEQRDVRKANLKEKKERNQNEALLQAIKARNIRLSEAACEDEDSASEGLGELFLDGLSTENPHGARLSLDGQGRLSWPVLFLYPEYAQSDFISAFHEDSRFIDHLMVMFGETPSWDLEQKYCPDNLEVYFEDEDRAELYRVPAKSTLLQVLQHQRYFVKALTPAFLVCVGSSPFCKNFLRGRKVYQIR

SEQ ID NO: 88166 - protein, 440 aa, Homo sapiens
  Payload ID: 17654
  Gene Name: tetratricopeptide repeat domain 5
  Uniprot ID: Q8N0Z6
  ENSP ID: ENSP00000258821
MMADEEEEVKPILQKLQELVDQLYSFRDCYFETHSVEDAGRKQQDVQKEMEKTLQQMEEVVGSVQGKAQVLMLTGKALNVTPDYSPKAEELLSKAVKLEPELVEAWNQLGEVYWKKGDVAAAHTCFSGALTHCRNKVSLQNLSMVLRQLRTDTEDEHSHHVMDSVRQAKLAVQMDVHDGRSWYILGNSYLSLYFSTGQNPKISQQALSAYAQAEKVDRKASSNPDLHLNRATLHKYEESYGEALEGFSRAAALDPAWPEPRQREQQLLEFLDRLTSLLESKGKVKTKKLQSMLGSLRPAHLGPCSDGHYQSASGQKVTLELKPLSTLQPGVNSGAVILGKVVFSLTTEEKVPFTFGLVDSDGPCYAVMVYNIVQSWGVLIGDSVAIPEPNLRLHRIQHKGKDYSFSSVRVETPLLLVVNGKPQGSSSQAVATVASRPQCE

SEQ ID NO: 88167 - protein, 128 aa, Homo sapiens
  Payload ID: 17654
  Gene Name: tetratricopeptide repeat domain 5
  ENSP ID: ENSP00000372496
MMADEEEEVKPILQKLQELVDQLYSFRDCYFETHSVEDAGRKQQDVQKEMEKTLQQMEEVVGSVQGKAQVLMLTGKALNVTPDYSPKAEELLSKAVKLEPELVEAWNQLVQEQSLLAKPVNGASSAAD

SEQ ID NO: 88168 - protein, 15 aa, Homo sapiens
  Payload ID: 17654
  Gene Name: tetratricopeptide repeat domain 5
  ENSP ID: ENSP00000451259
MEKTLQQMEEVVGSV

SEQ ID NO: 88169 - protein, 520 aa, Homo sapiens
  Payload ID: 17655
  Gene Name: tetratricopeptide repeat domain 6
  Uniprot ID: Q86TZ1
  ENSP ID: ENSP00000267368
MMKYYDLAKFTIYQIAEMDKGLSELSPMQQALIYSFCENHDKAIEVLDGISWNRAEMTMCALLAKVQMKAKRTKEAVEVLKKALDAISHSDKGPDATAISADCLYNLGLCYMEEGNLQMTYKLAITDLTTAISMDKNSYTAFYNRALCYTKIRELQMALTDYGIVLLLDATETVKLNTFLNRGLIYVELGQYGFALEDFKQAALISRTNGSLCHATAMCHHRINEFEEAVNFFTWALKINPCFLDAYVGRGNSYMEYGHDEATKQAQKDFLKALHINPAYIKARISFGYNLQAQGKFQKAWNHFTIAIDTDPKNYLAYEGRAVVCLQMGNNFAAMQDINAAMKISTTAEFLTNRGVIHEFMGHKQNAMKDYQDAITLNPKYSLAYFNAGNIYFHHRQFSQASDYFSKALKFDPENEYVLMNRAITNTILKKYEEAKEDFANVIESCPFWAAVYFNRAHFYYCLKQYELAEEDLNKALSLKPNDALVYNFRAKVRGKIGLIEEAMADYNQALDLEDYASVI

SEQ ID NO: 88170 - protein, 600 aa, Homo sapiens
  Payload ID: 17655
  Gene Name: tetratricopeptide repeat domain 6
  ENSP ID: ENSP00000371757
MDKGLSELSPMQQALIYSFCENHDKAIEVLDGISWNRAEMTMCALLAKVQMKAKRTKEAVEVLKKALDAISHSDKGPDATAISADCLYNLGLCYMEEGNLQMAFDSFTKAVKANPDFAESFYQRGLCKVKLHKDSSILDFNRAITLNPKHYQAYLSRVAFYGLKGRYSKAILNCNKAIKIYPESVRAYLYRGVLKYYNKTYKLAITDLTTAISMDKNSYTAFYNRALCYTKIRELQMALTDYGIVLLLDATETVKLNTFLNRGLIYVELGQYGFALEDFKQAALISRTNGSLCHATAMCHHRINEFEEAVNFFTWALKINPCFLDAYVGRGNSYMEYGHDEATKQAQKDFLKALHINPAYIKARISFGYNLQAQGKFQKAWNHFTIAIDTDPKNYLAYEGRAVVCLQMGNNFAAMQDINAAMKISTTAEFLTNRGVIHEFMGHKQNAMKDYQDAITLNPKYSLAYFNAGNIYFHHRQFSQASDYFSKALKFDPENEYVLMNRAITNTILKKYEEAKEDFANVIESCPFWAAVYFNRAHFYYCLKQYELAEEDLNKALSLKPNDALVYNFRAKVRGKIGLIEEAMADYNQALDLEDYASVI

SEQ ID NO: 88171 - protein, 520 aa, Homo sapiens; identical to SEQ ID NO: 88169
  Payload ID: 17655
  Gene Name: tetratricopeptide repeat domain 6
  Uniprot ID: Q86TZ1
  ENSP ID: ENSP00000417788

SEQ ID NO: 88172 - protein, 553 aa, Homo sapiens
  Payload ID: 17655
  Gene Name: tetratricopeptide repeat domain 6
  ENSP ID: ENSP00000419204
MMKYYDLAKFTIYQIAEMDKGLSELSPMQQALIYSFCENHDKAIEVLDGISWNRAEMTMCALLAKVQMKAKRTKEAVEVLKKALDAISHSDKGPDATAISADCLYNLGLCYMEEGNLQMAFDSFTKAVKANPDFAESFYQRGLCKVKLHKDSSILDFNRAITLNPKHYQAYLSRVAFYGLKGRYSKAILNCNKAIKIYPESVRAYLYRGVLKYYNKTYKLAITDLTTAISMDKNSYTAFYNRALCYTKIRELQMALTDYGIVLLLDATETVKLNTFLNRGLIYVELGQYGFALEDFKQAALISRTNGSLCHATAMCHHRINEFEEAVNFFTWALKINPCFLDAYVGRGNSYMEYGHDEATKQAQKDFLKALHINPAYIKARISFGYNLQAQGKFQKAWNHFTIAIDTDPKNYLAYEGRAVVCLQMGNNFAAMQDINAAMKISTTAEFLTNRGVIHEFMGHKQNAMKDYQDAITLNPKYSLAYFNAGNIYFHHRQFSQEESLGLAWSLSLDSFLRTGGATFSSGVNPLQTLHRRMSILSPLPPTCPRDEMDFTS

SEQ ID NO: 88173 - protein, 78 aa, Homo sapiens
  Payload ID: 17655
  Gene Name: tetratricopeptide repeat domain 6
  ENSP ID: ENSP00000450568
PKYSLAYFNAGNIYFHHRQFSQEESLGLAWSLSLDSFLRTGGATFSSGVNPLQTLHRRMSILSPLPPTCPRDEMDFTS

SEQ ID NO: 88174 - protein, 38 aa, Homo sapiens
  Payload ID: 17655
  Gene Name: tetratricopeptide repeat domain 6
  ENSP ID: ENSP00000450572
MKAQSTASMPPARPAPRAFPAPQPGRREDTLRLKALRC

SEQ ID NO: 88175 - protein, 1886 aa, Homo sapiens
  Payload ID: 17655
  Gene Name: tetratricopeptide repeat domain 6
  ENSP ID: ENSP00000451131
MSTIPRHFGLKYKEESYMFKELEKVRQETKKDFLRFKQKLASKPAVDESPVHSLHAPGPARPARVSCAAARTSRRYPSLKGPAMSAAALLQEVLGGAPRPSGLGEAAAPGKTRSFRPRDFYLRSSAFLRHQALKKPPVIASGFGTARPVVLLPPPEPPVKRRARGVLESSRHAAPRRVFHLGREREQSQEVAPLAGPCMAKERKASSVSAEDGYMEASSGRRKVRIRSNFVSESGAREAREAAGLGAQGEQESWPPSDAREAAWQALLPSRVIPTSIEEIIASLQSEAQLASDQTIKELIRSVLGQNYDITMEDISLMGKMYLKTSPMQAETPEIQAEYKFQMGAEESQMSVHKELSETMSSILQIEQEDIEWGPSEAESIVFKPQEISQVQPAEELSKPLEDGQPTSDSKEAKWVSLTAKSPEFLQIEGKEIKRMRKRKSLRPRKSSKPLCDKKLHKKIPQDYSMPHLHDLCTTIPAQELPVDLRLASRVYHTANRKGHDTLLGKFGTSFLDDRFTDEEQTDRILYGIPVMDDNQEYVHIPPTPQGIPPELAQGTRERAHKPHLEVLGEEMYAYPEFTKLFWNTAAPKFSVPESVMKETLYPKYESVQASRLLTDKLSYKSSVITLHQHSRTNFWCFLPRKSASFESIQKWFSAQPTQLRRVKSSVDLRKEKIIAPLEIKNDMQSSIKEVMFQKAKELKRQLQLTKQNKTEEPNYVKESIDDIFDNMCEKHSLRNLSLTLIEASKKAGISYIVYPKKKKMRWKKRLKQQKLIFVHEELSKPPKSLERSASHGILPGQKKYLFKVPLYERQIRCPSLPLYLNFEKFVQAKGGIPENIDPRTWALDRLIEYKDASIPVKEKDDKISVPEDPPERVKEPPKLKLNDYVESDLPQEVIKYYESEVKILTEEINDKTKYPAFAYCRRGAIYRKLGKLQSAMNDLQRVILLEPLFLNAYWHRHLIYLFQDKINEALDDLNYIHKYNKNNTEAYLSKAEIYRGKKDITLAILNYTQAIKSTPTDADIYFRRGEMYEITNKVLAIDDFSKCIFYDPKRTDALLKRGLFYCENENWFAAIEDFTALLNIDHQNSQARTYRGIAYVKWKFYKEATQDFSAAIHLDPNNWLALYYRGCLFRKSNPFRALQDYSVSALINDGYENLGCFLHRGIVYAHLKLWLLAICDFETVISLERTITLAYVNIGLIHLLHLDNYTEAIWQFSEAIRIDPLCIQSYLCRAETYFKLHKLKKAVNELSRAIHLQPDGIQLYIRRGQYLLMMKYYDLAKFTIYQIAEMDKGLSELSPMQQALIYSFCENHDKAIEVLDGISWNRAEMTMCALLAKVQMKAKRTKEAVEVLKKALDAISHSDKGPDATAISADCLYNLGLCYMEEGNLQMAFDSFTKAVKANPDFAESFYQRGLCKVKLHKDSSILDFNRAITLNPKHYQAYLSRVAFYGLKGRYSKAILNCNKAIKIYPESVRAYLYRGVLKYYNKTYKLAITDLTTAISMDKNSYTAFYNRALCYTKIRELQMALTDYGIVLLLDATETVKLNTFLNRGLIYVELGQYGFALEDFKQAALISRTNGSLCHATAMCHHRINEFEEAVNFFTWALKINPCFLDAYVGRGNSYMEYGHDEATKQAQKDFLKALHINPAYIKARISFGYNLQAQGKFQKAWNHFTIAIDTDPKNYLAYEGRAVVCLQMGNNFAAMQDINAAMKISTTAEFLTNRGVIHEFMGHKQNAMKDYQDAITLNPKYSLAYFNAGNIYFHHRQFSQASDYFSKALKFDPENEYVLMNRAITNTILKKYEEAKEDFANVIESCPFWAAVYFNRAHFYYCLKQYELAEEDLNKALSLKPNDALVYNFRAKVRGKIGLIEEAMADYNQALDLEDYASVI

SEQ ID NO: 88176 - protein, 440 aa, Homo sapiens
  Payload ID: 17655
  Gene Name: tetratricopeptide repeat domain 6
  ENSP ID: ENSP00000451566
MSTIPRHFGLKYKEESYMFKELEKVRQETKKDFLRFKQKLASKPAVDESPVHSLHAPGPARPARVSCAAARTSRRYPSLKGPAMSAAALLQEVLGGAPRPSGLGEAAAPGKTRSFRPRDFYLRSSAFLRHQALKKPPVIASGFGTARPVVLLPPPEPPVKRRARGVLESSRHAAPRRVFHLGREREQSQEVAPLAGPCMAKERKASSVSAEDGYMEASSGRRKVRIRSNFVSESGAREAREAAGLGAQGEQESWPPSDAREAAWQALLPSRVIPTSIEEIIASLQSEAQLASDQTIKELIRSVLGQNYDITMEDISLMGKMYLKTSPMQAETPEIQAEYKFQMGAEESQMSVHKELSETMSSILQIEQEDIEWGPSEAESIVFKPQEISQVQPAEELSKPLEDGQPTSDSKEAKWVSLTHTLYFLKGKITRILANRRKRN

SEQ ID NO: 88177 - protein, 858 aa, Homo sapiens
  Payload ID: 17656
  Gene Name: tetratricopeptide repeat domain 7A
  Uniprot ID: Q9ULT0
  ENSP ID: ENSP00000316699
MAAKGAHGSYLKVESELERCRAEGHWDRMPELVRQLQTLSMPGGGGNRRGSPSAAFTFPDTDDFGKLLLAEALLEQCLKENHAKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 88178 - protein, 882 aa, Homo sapiens
  Payload ID: 17656
  Gene Name: tetratricopeptide repeat domain 7A
  Uniprot ID: Q9ULT0
  ENSP ID: ENSP00000378320
MAAKGAHGSYLKVESELERCRAEGHWDRMPELVRQLQTLSMPGGGGNRRGSPSAAFTFPDTDDFGKLLLAEALLEQCLKENHAKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGDFRSPEGFQTPQRNICNSEIYRGGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 88179 - protein, 824 aa, Homo sapiens
  Payload ID: 17656
  Gene Name: tetratricopeptide repeat domain 7A
  ENSP ID: ENSP00000386307
MVPSSSRTPGFKQSSHHLRLPKCWDYRDDFGKLLLAEALLEQCLKENHAKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 88180 - protein, 66 aa, Homo sapiens
  Payload ID: 17656
  Gene Name: tetratricopeptide repeat domain 7A
  ENSP ID: ENSP00000386521
  MOD_RES (1)..(1): Any amino acid
XHAKIKDSMPLLEKNEPKMSEAKNYLSSILNHGRLSGLAVLLRLVSNSWAQAILLLQPPEALGLQE

SEQ ID NO: 88181 - protein, 330 aa, Homo sapiens
  Payload ID: 17656
  Gene Name: tetratricopeptide repeat domain 7A
  ENSP ID: ENSP00000393022
  MOD_RES (1)..(1): Any amino acid
XAAKGAHGSYLKVESELERCRAEGHWDRMPELVRQLQTLSMPGGGGNRRGSPSAAFTFPDTDDFGKLLLAEALLEQCLKENHAKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVPLLPQGQHRGSPPAPPHQRIHGNSRCGAEPGAGAGGGPDSELAECRSHL

SEQ ID NO: 88182 - protein, 108 aa, Homo sapiens
  Payload ID: 17656
  Gene Name: tetratricopeptide repeat domain 7A
  ENSP ID: ENSP00000401467
  MOD_RES (1)..(1): Any amino acid
XVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWPP

SEQ ID NO: 88183 - protein, 843 aa, Homo sapiens
  Payload ID: 17657
  Gene Name: tetratricopeptide repeat domain 7B
  Uniprot ID: Q86TV6
  ENSP ID: ENSP00000336127
MATKKAGSRLETEIERCRSECQWERIPELVKQLSAKLIANDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGNLTRGVGRFRELLRAVETRTTQNLRMTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAISPTHVKSMQRLALILHQLGRYSLAEKILRDAVQVNSTAHEVWNGLGEVLQAQGNDAAATECFLTALELEASSPAVPFTIIPRVL

SEQ ID NO: 88184 - protein, 105 aa, Homo sapiens
  Payload ID: 17657
  Gene Name: tetratricopeptide repeat domain 7B
  ENSP ID: ENSP00000450520
  MOD_RES (1)..(1): Any amino acid
XPQENTEEALLLLLISESMANRDAVLSRIPEHKSDRLISLQSASVVYDLLTIALGRRGQYEMLSEGPQPVTHRSPSSFLPGSAACHLQTDPRGSGVCPPSSSASR

SEQ ID NO: 88185 - protein, 48 aa, Homo sapiens
  Payload ID: 17657
  Gene Name: tetratricopeptide repeat domain 7B
  ENSP ID: ENSP00000451201
MAKLNYVEGDYKEALNIYARVGLDDLPLTAVPPYRLRVIAEAYATKGL

SEQ ID NO: 88186 - protein, 204 aa, Homo sapiens
  Payload ID: 17657
  Gene Name: tetratricopeptide repeat domain 7B
  ENSP ID: ENSP00000451238
MAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGGTDGNIKEPRMWFRVIEQDETRNLTRGVGRFRELLRAVETRTTQNLRMTIARQLAEILLRGMCEQSYWNPLED

SEQ ID NO: 88187 - protein, 330 aa, Homo sapiens
  Payload ID: 17657
  Gene Name: tetratricopeptide repeat domain 7B
  ENSP ID: ENSP00000451440
IPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGNSPEAYFHGFPSLFSVSSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAISPTHVKSMQRLALILHQLGRYSLAEKILRDAVQVNSTAHEVWNGLGEVLQAQGNDAAATECFLTALELEASSPAVPFTIIPRVL

SEQ ID NO: 88188 - protein, 417 aa, Homo sapiens
  Payload ID: 17657
  Gene Name: tetratricopeptide repeat domain 7B
  ENSP ID: ENSP00000451825
TIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGNQCSWIAFGEMLVDMGIQCI

SEQ ID NO: 88189 - protein, 175 aa, Homo sapiens
  Payload ID: 17657
  Gene Name: tetratricopeptide repeat domain 7B
  ENSP ID: ENSP00000451928
  MOD_RES (1)..(1): Any amino acid
XLTARSFKANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQ

SEQ ID NO: 88190 - protein, 271 aa, Homo sapiens
  Payload ID: 17657
  Gene Name: tetratricopeptide repeat domain 7B
  ENSP ID: ENSP00000452031
  MOD_RES (1)..(1): Any amino acid
XITLPDFSDPETVSDSSSSSSPLSRTESPLHLFVSSHLHSPKPDTFVWPPAAHSFSDAGPRREPSLCNSPEAYFHGFPSLFSVSSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAISPTHVKSMQRLALILHQLGRYSLAEKILRDAVQVNSTAHEVWNGLGEVLQAQGNDAAATECFLTALELEASSPAVPFTIIPRVL

SEQ ID NO: 88191 - protein, 213 aa, Homo sapiens
  Payload ID: 17657
  Gene Name: tetratricopeptide repeat domain 7B
  ENSP ID: ENSP00000452594
LQSLCRGPDEALLTCKHMLQIWKSCYNLTNPSDSGRGSSLLDRTIADRRQLNTITLPDFSDPETGSVHATSVAASRVEQALSEVASSLQSSAPKQGPLHPWMTLAQIWLHAGPDPSPARPLQSGGEDPPGRGAGELDSPRGLERAGRGPPSSGQRCGGYGVLPDSLGAGGQQPRRALHHHPPRALSRRLPASPAAQASEALPGTRACAIAPRG

SEQ ID NO: 88192 - protein, 475 aa, Homo sapiens
  Payload ID: 17658
  Gene Name: tetratricopeptide repeat domain 8
  ENSP ID: ENSP00000298324
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 88193 - protein, 531 aa, Homo sapiens
  Payload ID: 17658
  Gene Name: tetratricopeptide repeat domain 8
  ENSP ID: ENSP00000337653
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTIHLEDVVLHLGIYPFLLRNKNHIEKNALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 88194 - protein, 515 aa, Homo sapiens
  Payload ID: 17658
  Gene Name: tetratricopeptide repeat domain 8
  Uniprot ID: Q8TAM2
  ENSP ID: ENSP00000339486
MSSEMEPLLLAWSYFRRRKFQLCADLCTQMLEKSPYDQEPDPELPVHQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 88195 - protein, 250 aa, Homo sapiens
  Payload ID: 17658
  Gene Name: tetratricopeptide repeat domain 8
  Uniprot ID: Q8TAM2
  ENSP ID: ENSP00000346427
MSSEMEPLLLAWSYFRRRKFQLCADLCTQMLEKSPYDQEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 88196 - protein, 317 aa, Homo sapiens
  Payload ID: 17658
  Gene Name: tetratricopeptide repeat domain 8
  ENSP ID: ENSP00000351439
MILSYEVILHALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 88197 - protein, 515 aa, Homo sapiens; identical to SEQ ID NO: 88194
  Payload ID: 17658
  Gene Name: tetratricopeptide repeat domain 8
  Uniprot ID: Q8TAM2
  ENSP ID: ENSP00000370031

SEQ ID NO: 88198 - protein, 475 aa, Homo sapiens; identical to SEQ ID NO: 88192
  Payload ID: 17658
  Gene Name: tetratricopeptide repeat domain 8
  ENSP ID: ENSP00000445067

SEQ ID NO: 88199 - protein, 41 aa, Homo sapiens
  Payload ID: 17658
  Gene Name: tetratricopeptide repeat domain 8
  ENSP ID: ENSP00000450905
MSSEMEPLLLAWSYFRRRKFQLCADLCTQMLEKSPYDQSCS

SEQ ID NO: 88200 - protein, 186 aa, Homo sapiens
  Payload ID: 17658
  Gene Name: tetratricopeptide repeat domain 8
  ENSP ID: ENSP00000450951
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKVCT

SEQ ID NO: 88201 - protein, 192 aa, Homo sapiens
  Payload ID: 17658
  Gene Name: tetratricopeptide repeat domain 8
  ENSP ID: ENSP00000450993
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALDLAALST

SEQ ID NO: 88202 - protein, 211 aa, Homo sapiens
  Payload ID: 17658
  Gene Name: tetratricopeptide repeat domain 8
  ENSP ID: ENSP00000451034
MSSEMEPLLLAWSYFRRRKFQLCADLCTQMLEKSPYDQKISWAWWHVPVIPATWEAEAGELLEPRKRRLQQAEITPLYSSLGNKSKTPSQKAAWILKARALTEMVYIDEIDVDQEGIAEMMLDENAIAQVPRPGTSLKLPGTNQTGGPSQAANHTSWKTHYRFPQAQHAEWKARHYGTGYQNTQNRLHSPPYHQLLRKICQAGNGFHAYKS

SEQ ID NO: 88203 - protein, 265 aa, Homo sapiens
  Payload ID: 17658
  Gene Name: tetratricopeptide repeat domain 8
  ENSP ID: ENSP00000451955
  MOD_RES (1)..(1): Any amino acid
XSIPRNLSWQRLCLSISFIMKMMLRLLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISD

SEQ ID NO: 88204 - protein, 437 aa, Homo sapiens
  Payload ID: 17658
  Gene Name: tetratricopeptide repeat domain 8
  ENSP ID: ENSP00000452354
  MOD_RES (1)..(1): Any amino acid
XWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQIGDLQRSYVAAQKSEAAFPDHVDTQHLIKQLRQHFAML

SEQ ID NO: 88205 - protein, 531 aa, Homo sapiens; identical to SEQ ID NO: 88193
  Payload ID: 17658
  Gene Name: tetratricopeptide repeat domain 8
  ENSP ID: ENSP00000482306

SEQ ID NO: 88206 - protein, 505 aa, Homo sapiens
  Payload ID: 17658
  Gene Name: tetratricopeptide repeat domain 8
  ENSP ID: ENSP00000482721
MSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 88207 - protein, 222 aa, Homo sapiens
  Payload ID: 17659
  Gene Name: tetratricopeptide repeat domain 9
  Uniprot ID: Q92623
  ENSP ID: ENSP00000256367
MERKGSAAGAKGNPSPPAAGEGQRPPPPLCVPGGGGGAPARGQVGAAAEPAELIRRAHEFKSQGAQCYKDKKFREAIGKYHRALLELKGLLPPPGERERDSRPASPAGALKPGRLSEEQSKTVEAIEIDCYNSLAACLLQAELVNYERVKEYCLKVLKKEGENFKALYRSGVAFYHLGDYDKALYYLKEARTQQPTDTNVIRYIQLTEMKLSRCSQREKEAM

SEQ ID NO: 88208 - protein, 239 aa, Homo sapiens
  Payload ID: 17660
  Gene Name: tetratricopeptide repeat domain 9B
  Uniprot ID: Q8N6N2
  ENSP ID: ENSP00000311760
MQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPAPGPTSSPGPARLSEEQRRLVESTEVECYDSLTACLLQSELVNYERVREYCLKVLEKQQGNFKATYRAGIAFYHLGDYARALRYLQEARSREPTDTNVLRYIQLTQLKMNRCSLQREDSGAGSQTRDVIG

SEQ ID NO: 88209 - protein, 82 aa, Homo sapiens
  Payload ID: 17661
  Gene Name: tetratricopeptide repeat domain 9C
  ENSP ID: ENSP00000294161
MEKRLQEAQLYKEEGNQRYREGKYRDAVSRYHRALLQLRGLDPSLPSPLPNLGPQGPALTPEQENILHTTQTDCYNNLAVVK

SEQ ID NO: 88210 - protein, 171 aa, Homo sapiens
  Payload ID: 17661
  Gene Name: tetratricopeptide repeat domain 9C
  Uniprot ID: Q8N5M4
  ENSP ID: ENSP00000325266
MEKRLQEAQLYKEEGNQRYREGKYRDAVSRYHRALLQLRGLDPSLPSPLPNLGPQGPALTPEQENILHTTQTDCYNNLAACLLQMEPVNYERVREYSQKVLERQPDNAKALYRAGVAFFHLQDYDQARHYLLAAVNRQPKDANVRRYLQLTQSELSSYHRKEKQLYLGMFG

SEQ ID NO: 88211 - protein, 69 aa, Homo sapiens
  Payload ID: 17661
  Gene Name: tetratricopeptide repeat domain 9C
  ENSP ID: ENSP00000434137
RQPDNAKALYRAGVAFFHLQDYDQARHYLLAAVNRQPKDANVRRYLQLTQSELSSYHRKEKQLYLGMFG

SEQ ID NO: 88212 - protein, 171 aa, Homo sapiens; identical to SEQ ID NO: 88210
  Payload ID: 17661
  Gene Name: tetratricopeptide repeat domain 9C
  Uniprot ID: Q8N5M4
  ENSP ID: ENSP00000434340

SEQ ID NO: 88213 - protein, 140 aa, Homo sapiens
  Payload ID: 17661
  Gene Name: tetratricopeptide repeat domain 9C
  ENSP ID: ENSP00000435282
MEKRLQEAQLYKEEGNQRYREGKYRDAVSRYHRALLQLRGLDPSLPSPLPNLGPQGPALTPEQENILHTTQTDCYNNLAACLLQMEPVNYERVREYSQKVLERQPDNAKALYRAGVAFFHLQDYDQARHYLLAAVNRQPK

SEQ ID NO: 88214 - protein, 1861 aa, Homo sapiens
  Payload ID: 17662
  Gene Name: tetratricopeptide repeat, ankyrin repeat and coiled-coil containing 1
  Uniprot ID: Q9C0D5
  ENSP ID: ENSP00000263635
MLKAVLKKSREGGKGGKKEAGSDFGPETSPVLHLDHSADSPVSSLPTAEDTYRVSLAKGVSMSLPSSPLLPRQSHLVQSRVNKKSPGPVRKPKYVESPRVPGDAVIMPFREVAKPTEPDEHEAKADNEPSCSPAAQELLTRLGFLLGEGIPSATHITIEDKNETMCTALSQGISPCSTLTSSTASPSTDSPCSTLNSCVSKTAANKSPCETISSPSSTLESKDSGIIATITSSSENDDRSGSSLEWNKDGNLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 88215 - protein, 462 aa, Homo sapiens
  Payload ID: 17662
  Gene Name: tetratricopeptide repeat, ankyrin repeat and coiled-coil containing 1
  ENSP ID: ENSP00000396339
MPFREVAKPTEPDEHATITSSSENDDRSGSSLEWNKDGNLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHASIQQHKDVKFNQ

SEQ ID NO: 88216 - protein, 2000 aa, Homo sapiens
  Payload ID: 17663
  Gene Name: tetratricopeptide repeat, ankyrin repeat and coiled-coil containing 2
  Uniprot ID: Q9HCD6
  ENSP ID: ENSP00000374171
MFRNSLKMLLTGGKSSRKNRSSDGGSEEPPDRRQSSVDSRQSRSGQGGISTESDCAFEPDYAVPPLPVSEGDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGCQTLPSRPRGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 88217 - protein, 1990 aa, Homo sapiens
  Payload ID: 17663
  Gene Name: tetratricopeptide repeat, ankyrin repeat and coiled-coil containing 2
  Uniprot ID: Q9HCD6
  ENSP ID: ENSP00000387593
MFRNSLKMLLTGGKSSRKNRSSDGGSEEPPDRRQSSVDSRQSRSGQGGISTESDCAFEPDYAVPPLPVSEGDAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 88218 - protein, 1254 aa, Homo sapiens
  Payload ID: 17663
  Gene Name: tetratricopeptide repeat, ankyrin repeat and coiled-coil containing 2
  ENSP ID: ENSP00000462109
  MOD_RES (1)..(1): Any amino acid
XAEQELGPPPSVDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGPATWAMATSKPDIMIILLSKLMEEGDMFYKKGKVKEAAQRYQYALKKFPREGFGEDLKTFRELKVSLLLNLSRCRRKMNTVRSSLRGPERGHQAVSQQP

SEQ ID NO: 88219 - protein, 152 aa, Homo sapiens
  Payload ID: 17663
  Gene Name: tetratricopeptide repeat, ankyrin repeat and coiled-coil containing 2
  ENSP ID: ENSP00000463062
GGSEEPPDRRQSSVDSRQSRSGQGGISTESDCAFEPDYAVPPLPVSEGMQHIRIMEGMSRSLPSSPLLTHQSISVRLQPVKKLTAPLRKAKFVESPRIPESELGSPTLTSAQKLDVDAYCPGDAEQELGPPPSVDEAANTLMTRLGFLLGEK

SEQ ID NO: 88220 - protein, 111 aa, Homo sapiens
  Payload ID: 17663
  Gene Name: tetratricopeptide repeat, ankyrin repeat and coiled-coil containing 2
  ENSP ID: ENSP00000463959
  MOD_RES (1)..(1): Any amino acid
XPPDRRQSSVDSRQSRSGQGGISTESDCAFEPDYAVPPLPVSEGMQHIRIMEGMSRSLPSSPLLTHQSISVRLQPVKKLTGDAEQELGPPPSVDEAANTLMTRLGFLLGEK

SEQ ID NO: 88221 - protein, 135 aa, Homo sapiens
  Payload ID: 17663
  Gene Name: tetratricopeptide repeat, ankyrin repeat and coiled-coil containing 2
  ENSP ID: ENSP00000464181
VDHLDKNGQCALVHAALRGHLEVVKFLIQCDWTMAGQQQGVFKKSHAIQQALIAAASMGYTEIVSYLLDLPEKDEEEVERAQINSFDSLWGETGTSHGRCPQECVVFVWTLESHPLIFSLAYIWQSSVSGFCNAD

SEQ ID NO: 88222 - protein, 1100 aa, Homo sapiens
  Payload ID: 17663
  Gene Name: tetratricopeptide repeat, ankyrin repeat and coiled-coil containing 2
  ENSP ID: ENSP00000478576
MVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKSQDRLSDVPSRPRGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 88223 - protein, 993 aa, Homo sapiens
  Payload ID: 17664
  Gene Name: TEX13 family member C
  ENSP ID: ENSP00000488022
MAMNFGDHASGFRHDDVIRFINNEVLRNGGSPAFYTAFRSRPWNEVEDRLRAIVADPRVPRAIKRACTWSALALSVQVAARQQEELLYQVWWLQGHVEECQATSWALTSQLQQLRLEHEEVATQLHLTQAALQQVLNERDGLCGRLLEVERSMQVYPMPQDFVPGPEAGQYGPVAGTLNAEQSEAVATEAQGMPHSEAQVAAPTAVYYMPEPQSGRVQGMQPLLLMQAPHPVPFHMPSPMGLPYSTPLPPPVVMESAAAIAPQMPPAGIYPPGLWATVGSQEETAPPWDQKCHGQDGYPENFQGVYHPGDNRSCNQKEGSECPQGMTSQGDSSSHSLKKDPVMQEGTAPPEFSRSHSLEKKPVMPKEMVPLGDSNSHSLKKDPVVPKEIVPIGDSNSHSLTKNPVVHKEMVSLGDSNSHSMKKDPVMPQKMVPLGDSNSHSLKKDPMMCQEMVPLGDSNSHSLKKDPVVAQGTAPLMYSRRHSQKKVPMMPKEMVPLGESHSHSLKKDLVVPKELVPLGDSKSHRMKKDPVMPQKMVPLGDSRSHSLKKDPVMPQNMIPLEDSNSHSLKKDPVMPQNMIPLEDSNSHSLKKDPMMHQEMVPLGDSNSHSLKKDPVVPQDTAPLMFSRRHSLKKVPVMPKEMVPLGDSHSLKKDPVMPQNMVPLEDSNSHSLKKDPVVPQGTAPLMFSRRHSLKKVPVMPKEMVPLGDSNSHSLKKDPVVPQGTAPLMFSRRHSLKKVPVMPKEMVPLGDSHSLKKDPVMPQNMVPLEDSNSHSLKKDPVVPQGTAPLTFSRRHSLKKVPVVPQGTASLGFSRIHSLKKELVMPEEMVPLGDSNSHSMKKDLVMPKEMVPLGDSNSHSLKKDPVVHQEVVSLGDSNSHSLKKHPVIPQGTASLRFSKSHSQKEDQERPQVTPLEDSKSHGVKNSPWKHQPQGQKVKEQKRKKASESQQQKPASCSSPVNWACPWCNAMNFPRNKVCSKCKRVRMPVENGSVDPA

SEQ ID NO: 88224 - protein, 714 aa, Homo sapiens
  Payload ID: 17665
  Gene Name: TEX13 family member D
  ENSP ID: ENSP00000488696
MAMNFGDHASGFRHNDVIRFINNEVLMDGSGPAFYVAFRSRPWNEVEDSLQAIVADSQVPRAIKRACTWSALALSVRVATRQREELLHHVRRLQRHAEERQATSWALTSQLQQLRLEHEVAATQLHLAQAALQQALNERDGLYGRLLQIERFPQAAPLAHEIMSGPQAEQNGAAACPLATEQQSDMVAMGTHANAQMPTPTDVLYVPGPLSPWAQGMQPPLPVPHPFPHPPPFPMKFPSLPPLPPAVVTGAEAAAVPLQMPPTEIHPPCPWPAVGFQEEMAPLWYQRSYIQEEDSKILQGSFPLGDSRSHSQGEGSERSQRMPLPGDSGCHNPLSESPQGTAPLGSSGCHSQEEGTEGPQGMDPLGNRERQNQKEGPKRARRMHTLVFRRSHKSEGPEGPQGTVPQGDSRSYSQEGCSDRAQEMATLVFIRRCKPEGPKRPQWTVPLGDSRSHIKEEGPEGPQRIVLQGDNRSYSQEGSPERAQGMATLVFSRSCKPEEGPERPQDTPLGDSRSHIKEEGPEGPQRIVLQGDNRSYSQEGSPERAQGMATLVFSRSCKPEEGPERPQDTPLGDSRSHIKEEGPEGPQRIVLQGDNRSYSQEGSRERAQGMATLVFSRSCKPEEGPERPQGTPLGDSRSHGVRESPKKWQPQRQKAKKPKVNKVSGSQQQEKPASFPVPVNWKCPWCKAINFSWRTACYKCKKACVPFESGGQTQ

SEQ ID NO: 88225 - protein, 115 aa, Homo sapiens
  Payload ID: 17666
  Gene Name: TGFB1-induced anti-apoptotic factor 1
  Uniprot ID: O95411
  ENSP ID: ENSP00000352424
MSSPSSPFREQSFLCAAGDAGEESRVQVLKNEVRRGSPVLLGWVEQAYADKCVCGPSAPPAPTPPSLSQRVMCNDLFKVNPFQLQQFRADPSTASLLLCPGGLDHKLNLRGKAWG

SEQ ID NO: 88226 - protein, 504 aa, Homo sapiens
  Payload ID: 17667
  Gene Name: TGF-beta activated kinase 1/MAP3K7 binding protein 1
  Uniprot ID: Q15750
  ENSP ID: ENSP00000216160
MAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 88227 - protein, 462 aa, Homo sapiens
  Payload ID: 17667
  Gene Name: TGF-beta activated kinase 1/MAP3K7 binding protein 1
  Uniprot ID: Q15750
  ENSP ID: ENSP00000333049
MAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTKDPSRPASDLTAIPQCQLNLLGSLTPG

SEQ ID NO: 88228 - protein, 693 aa, Homo sapiens
  Payload ID: 17668
  Gene Name: TGF-beta activated kinase 1/MAP3K7 binding protein 2
  Uniprot ID: Q9NYJ8
  ENSP ID: ENSP00000356426
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQALLVHQKARMERLQRELEIQKKKLDKLKSEVNEMENNLTRRRLKRSNSISQIPSLEEMQQLRSCNRQLQIDIDCLTKEIDLFQARGPHFNPSAIHNFYDNIGFVGPVPPKPKDQRSIIKTPKTQDTEDDEGAQWNCTACTFLNHPALIRCEQCEMPRHF

SEQ ID NO: 88229 - protein, 536 aa, Homo sapiens
  Payload ID: 17668
  Gene Name: TGF-beta activated kinase 1/MAP3K7 binding protein 2
  Uniprot ID: Q9NYJ8
  ENSP ID: ENSP00000432709
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQDI

SEQ ID NO: 88230 - protein, 693 aa, Homo sapiens; identical to SEQ ID NO: 88228
  Payload ID: 17668
  Gene Name: TGF-beta activated kinase 1/MAP3K7 binding protein 2
  Uniprot ID: Q9NYJ8
  ENSP ID: ENSP00000445752

SEQ ID NO: 88231 - protein, 33 aa, Homo sapiens
  Payload ID: 17668
  Gene Name: TGF-beta activated kinase 1/MAP3K7 binding protein 2
  ENSP ID: ENSP00000475580
MAQGSHQIDFQVLHDLRQKFPEVPEVARGNRPD

SEQ ID NO: 88232 - protein, 130 aa, Homo sapiens
  Payload ID: 17668
  Gene Name: TGF-beta activated kinase 1/MAP3K7 binding protein 2
  ENSP ID: ENSP00000476139
MTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPV

SEQ ID NO: 88233 - protein, 47 aa, Homo sapiens
  Payload ID: 17669
  Gene Name: TGF-beta activated kinase 1/MAP3K7 binding protein 3
  ENSP ID: ENSP00000288422
MAQSSPQLDIQVLHDLRQRFPEIPEGVVSQCMLQNNNNLEACCRALS

SEQ ID NO: 88234 - protein, 712 aa, Homo sapiens
  Payload ID: 17669
  Gene Name: TGF-beta activated kinase 1/MAP3K7 binding protein 3
  Uniprot ID: Q8N5C8
  ENSP ID: ENSP00000368212
MAQSSPQLDIQVLHDLRQRFPEIPEGVVSQCMLQNNNNLEACCRALSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQPPQQPSSMQTGMNPSAMQGPSPPPPPPSYMHIPRYSTNPITVTVSQNLPSGQTVPRALQILPQIPSNLYGSPGSIYIRQTSQSSSGRQTPQSTPWQSSPQGPVPHYSQRPLPVYPHQQNYQPSQYSPKQQQIPQSAYHSPPPSQCPSPFSSPQHQVQPSQLGHIFMPPSPSTTPPHPYQQGPPSYQKQGSHSVAYLPYTASSLSKGSMKKIEITVEPSQRPGTAINRSPSPISNQPSPRNQHSLYTATTPPSSSPSRGISSQPKPPFSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSRGNFDPKAMNNFYDNIEPGPVVPPKPSKKDSSDPCTIERKARRISVTSKVQADIHDTQAAAADEHRTGSTQSPRTQPRDEDYEGAPWNCDSCTFLNHPALNRCEQCEMPRYT

SEQ ID NO: 88235 - protein, 684 aa, Homo sapiens
  Payload ID: 17669
  Gene Name: TGF-beta activated kinase 1/MAP3K7 binding protein 3
  Uniprot ID: Q8N5C8
  ENSP ID: ENSP00000368214
MAQSSPQLDIQVLHDLRQRFPEIPEGVVSQCMLQNNNNLEACCRALSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQPPQQPSSMQTGMNPSAMQGPSPPPPPPSYMHIPRYSTNPITVTVSQNLPSGQTVPRALQILPQIPSNLYGSPGSIYIRQTSQSSSGRQTPQSTPWQSSPQGPVPHYSQRPLPVYPHQQNYQPSQYSPKQQQIPQSAYHSPPPSQCPSPFSSPQHQVQPSQLGHIFMPPSPSTTPPHPYQQGPPSYQKQGSHSVAYLPYTASSLSKGSMKKIEITVEPSQRPGTAINRSPSPISNQPSPRNQHSLYTATTPPSSSPSRGISSQPKPPFSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSRDSSDPCTIERKARRISVTSKVQADIHDTQAAAADEHRTGSTQSPRTQPRDEDYEGAPWNCDSCTFLNHPALNRCEQCEMPRYT

SEQ ID NO: 88236 - protein, 712 aa, Homo sapiens; identical to SEQ ID NO: 88234
  Payload ID: 17669
  Gene Name: TGF-beta activated kinase 1/MAP3K7 binding protein 3
  Uniprot ID: Q8N5C8
  ENSP ID: ENSP00000368215

SEQ ID NO: 88237 - protein, 608 aa, Homo sapiens
  Payload ID: 17669
  Gene Name: TGF-beta activated kinase 1/MAP3K7 binding protein 3
  ENSP ID: ENSP00000433193
MAQSSPQLDIQVLHDLRQRFPEIPEGVVSQCMLQNNNNLEACCRALSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQPPQQPSSMQTGMNPSAMQGPSPPPPPPSYMHIPRYSTNPITVTVSQNLPSGQTVPRALQILPQIPSNLYGSPGSIYIRQTSQSSSGRQTPQSTPWQSSPQGPVPHYSQRPLPVYPHQQNYQPSQYSPKQQQIPQSAYHSPPPSQCPSPFSSPQHQVQPSQLGHIFMPPSPSTTPPHPYQQGPPSYQKQGSHSVAYLPYTASSLSKGSMKKIEITVEPSQRPGTAINRSPSPISNQPSPRNQHSLYTATTPPSSSPSRGISSQPKPPFSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSRGIDLIIW

SEQ ID NO: 88238 - protein, 401 aa, Homo sapiens
  Payload ID: 17670
  Gene Name: TGFB-induced factor homeobox 1
  Uniprot ID: Q15583
  ENSP ID: ENSP00000327959
MVLAQSRVSAGVGSPHCSGSGGGGSDSFPWPASHPGNPQCSFSTAFLASPRLSRGTLAYLPPAPWSSLATPSALLGSSCAPPPPPARCPQPRALSPELGTKAGPRRPHRWELPRSPSQGAQGPAPRRRLLETMKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 88239 - protein, 272 aa, Homo sapiens
  Payload ID: 17670
  Gene Name: TGFB-induced factor homeobox 1
  Uniprot ID: Q15583
  ENSP ID: ENSP00000339631
MKGKKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 88240 - protein, 252 aa, Homo sapiens
  Payload ID: 17670
  Gene Name: TGFB-induced factor homeobox 1
  Uniprot ID: Q15583
  ENSP ID: ENSP00000343969
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 88241 - protein, 252 aa, Homo sapiens; identical to SEQ ID NO: 88240
  Payload ID: 17670
  Gene Name: TGFB-induced factor homeobox 1
  Uniprot ID: Q15583
  ENSP ID: ENSP00000383031

SEQ ID NO: 88242 - protein, 272 aa, Homo sapiens; identical to SEQ ID NO: 88239
  Payload ID: 17670
  Gene Name: TGFB-induced factor homeobox 1
  Uniprot ID: Q15583
  ENSP ID: ENSP00000384133

SEQ ID NO: 88243 - protein, 252 aa, Homo sapiens; identical to SEQ ID NO: 88240
  Payload ID: 17670
  Gene Name: TGFB-induced factor homeobox 1
  Uniprot ID: Q15583
  ENSP ID: ENSP00000384970

SEQ ID NO: 88244 - protein, 252 aa, Homo sapiens; identical to SEQ ID NO: 88240
  Payload ID: 17670
  Gene Name: TGFB-induced factor homeobox 1
  Uniprot ID: Q15583
  ENSP ID: ENSP00000385206

SEQ ID NO: 88245 - protein, 137 aa, Homo sapiens
  Payload ID: 17670
  Gene Name: TGFB-induced factor homeobox 1
  ENSP ID: ENSP00000446838
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLS

SEQ ID NO: 88246 - protein, 132 aa, Homo sapiens
  Payload ID: 17670
  Gene Name: TGFB-induced factor homeobox 1
  ENSP ID: ENSP00000446944
MKGKKGIVAASGSETEDEDSMDIPLDLSSSAGSGKRRRRGNLPKESVQILRDWLYEHRYNAYPSEQEKALLSQQTHLSTLQVKKESVRFMDAFLVSKSFYGIPVCQVIKLLATQRQKEYLFIVNLIVLKANN

SEQ ID NO: 88247 - protein, 252 aa, Homo sapiens; identical to SEQ ID NO: 88240
  Payload ID: 17670
  Gene Name: TGFB-induced factor homeobox 1
  Uniprot ID: Q15583
  ENSP ID: ENSP00000447747

SEQ ID NO: 88248 - protein, 219 aa, Homo sapiens
  Payload ID: 17670
  Gene Name: TGFB-induced factor homeobox 1
  ENSP ID: ENSP00000448121
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPT

SEQ ID NO: 88249 - protein, 118 aa, Homo sapiens
  Payload ID: 17670
  Gene Name: TGFB-induced factor homeobox 1
  ENSP ID: ENSP00000448934
MKGKKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKIS

SEQ ID NO: 88250 - protein, 167 aa, Homo sapiens
  Payload ID: 17670
  Gene Name: TGFB-induced factor homeobox 1
  ENSP ID: ENSP00000449287
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFS

SEQ ID NO: 88251 - protein, 252 aa, Homo sapiens; identical to SEQ ID NO: 88240
  Payload ID: 17670
  Gene Name: TGFB-induced factor homeobox 1
  Uniprot ID: Q15583
  ENSP ID: ENSP00000449501

SEQ ID NO: 88252 - protein, 131 aa, Homo sapiens
  Payload ID: 17670
  Gene Name: TGFB-induced factor homeobox 1
  ENSP ID: ENSP00000449531
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPT

SEQ ID NO: 88253 - protein, 245 aa, Homo sapiens
  Payload ID: 17670
  Gene Name: TGFB-induced factor homeobox 1
  ENSP ID: ENSP00000449580
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEME

SEQ ID NO: 88254 - protein, 133 aa, Homo sapiens
  Payload ID: 17670
  Gene Name: TGFB-induced factor homeobox 1
  ENSP ID: ENSP00000449722
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLG

SEQ ID NO: 88255 - protein, 91 aa, Homo sapiens
  Payload ID: 17670
  Gene Name: TGFB-induced factor homeobox 1
  ENSP ID: ENSP00000449973
MDIPLDLSSSAGSGKRRRRGNLPKESVQILRDWLYEHRYNAYPSEQEKALLSQQTHLSTLQVCNWFINARRRLLPDMLRKDGKDPNQFTIS

SEQ ID NO: 88256 - protein, 252 aa, Homo sapiens; identical to SEQ ID NO: 88240
  Payload ID: 17670
  Gene Name: TGFB-induced factor homeobox 1
  Uniprot ID: Q15583
  ENSP ID: ENSP00000450025

SEQ ID NO: 88257 - protein, 84 aa, Homo sapiens
  Payload ID: 17670
  Gene Name: TGFB-induced factor homeobox 1
  ENSP ID: ENSP00000462285
MKGKKGIVAASGSETEDEDSMDIPLDLSSSAGSGKRRRRGNLPKESVQILRDWLYEHRYNAYPSEQEKALLSQQTHLSTLQAPP

SEQ ID NO: 88258 - protein, 286 aa, Homo sapiens
  Payload ID: 17670
  Gene Name: TGFB-induced factor homeobox 1
  Uniprot ID: Q15583
  ENSP ID: ENSP00000483499
MTCSGKSCALARSSLTSSQGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 88259 - protein, 237 aa, Homo sapiens
  Payload ID: 17671
  Gene Name: TGFB-induced factor homeobox 2
  Uniprot ID: Q9GZN2
  ENSP ID: ENSP00000362979
MSDSDLGEDEGLLSLAGKRKRRGNLPKESVKILRDWLYLHRYNAYPSEQEKLSLSGQTNLSVLQICNWFINARRRLLPDMLRKDGKDPNQFTISRRGGKASDVALPRGSSPSVLAVSVPAPTNVLSLSVCSMPLHSGQGEKPAAPFPRGELESPKPLVTPGSTLTLLTRAEAGSPTGGLFNTPPPTPPEQDKEDFSSFQLLVEVALQRAAEMELQKQQDPSLPLLHTPIPLVSENPQ

SEQ ID NO: 88260 - protein, 237 aa, Homo sapiens; identical to SEQ ID NO: 88259
  Payload ID: 17671
  Gene Name: TGFB-induced factor homeobox 2
  Uniprot ID: Q9GZN2
  ENSP ID: ENSP00000362981

SEQ ID NO: 88261 - protein, 174 aa, Homo sapiens
  Payload ID: 17671
  Gene Name: TGFB-induced factor homeobox 2
  ENSP ID: ENSP00000452878
MSDSDLGEDEGLLSLAGKRKRRGNLPKESVKILRDWLYLHRYNAYPSEQEKLSLSGQTNLSVLQICNWFINARRRLLPDMLRKDGKDPNQFTISRRGGKASDVALPRGSSPSVLAVSVPAPTNVLSLSVCSMPLHSGQGEKPAAPFPRGELESPKPLVTPGSTLTLLTRAEAGS

SEQ ID NO: 88262 - protein, 237 aa, Homo sapiens; identical to SEQ ID NO: 88259
  Payload ID: 17671
  Gene Name: TGFB-induced factor homeobox 2
  Uniprot ID: Q9GZN2
  ENSP ID: ENSP00000453773

SEQ ID NO: 88263 - protein, 35 aa, Homo sapiens
  Payload ID: 17671
  Gene Name: TGFB-induced factor homeobox 2
  ENSP ID: ENSP00000475479
KLSLSGQTNLSVLQRSSTGRCQLAPLHCDGGPLLC

SEQ ID NO: 88264 - protein, 92 aa, Homo sapiens
  Payload ID: 17671
  Gene Name: TGFB-induced factor homeobox 2
  ENSP ID: ENSP00000475729
  MOD_RES (1)..(1): Any amino acid
XLLSLAGKRKRRGNLPKESVKILRDWLYLHRYNAYPSEQEKLSLSGQTNLSVLQRVFYGSLPNIGIISSVQRSSTGRCQLAPLHCDGGPLLC

SEQ ID NO: 88265 - protein, 111 aa, Homo sapiens
  Payload ID: 17671
  Gene Name: TGFB-induced factor homeobox 2
  ENSP ID: ENSP00000476174
  MOD_RES (1)..(1): Any amino acid
XRKRRGNLPKESVKILRDWLYLHRYNAYPSEQEKLSLSGQTNLSVLQICNWFINARRRLLPDMLRKDGKDPNQFTISRRGEGFLWITAKHWDHLLCPEVFNRKMPAGTTAL

SEQ ID NO: 88266 - protein, 237 aa, Homo sapiens; identical to SEQ ID NO: 88259
  Payload ID: 17671
  Gene Name: TGFB-induced factor homeobox 2
  Uniprot ID: Q9GZN2
  ENSP ID: ENSP00000481787

SEQ ID NO: 88267 - protein, 241 aa, Homo sapiens
  Payload ID: 17672
  Gene Name: TGFB-induced factor homeobox 2-like, X-linked
  Uniprot ID: Q8IUE1
  ENSP ID: ENSP00000355119
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLQISNWFINARRRILPDMLQQRRNDPIIGHKTGKDAHATHLQSTEASVPAKSGPSGPDNVQSLPLWPLPKGQMSREKQPDPESAPSQKLTGIAQPKKKVKVSVTSPSSPELVSPEEHADFSSFLLLVDAAVQRAAELELEKKQEPNP

SEQ ID NO: 88268 - protein, 241 aa, Homo sapiens; identical to SEQ ID NO: 88267
  Payload ID: 17672
  Gene Name: TGFB-induced factor homeobox 2-like, X-linked
  Uniprot ID: Q8IUE1
  ENSP ID: ENSP00000453704

SEQ ID NO: 88269 - protein, 185 aa, Homo sapiens [sequence omitted]

SEQ ID NO: 88270 - protein, 185 aa, Homo sapiens
  Payload ID: 17673
  Gene Name: TGFB-induced factor homeobox 2-like, Y-linked
  Uniprot ID: Q8IUE0
  ENSP ID: ENSP00000318502
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLRISNWFINARRRILPDMLQQRRNDPIIGHKTGKDAHATHLQSTEASVPAKSGPVVQTMYKACPCGPCQRARCQERSNQIRSRPLARSSPE

SEQ ID NO: 88271 - protein, 185 aa, Homo sapiens; identical to SEQ ID NO: 88270
  Payload ID: 17673
  Gene Name: TGFB-induced factor homeobox 2-like, Y-linked
  Uniprot ID: Q8IUE0
  ENSP ID: ENSP00000453750

SEQ ID NO: 88272 - protein, 155 aa, Homo sapiens
  Payload ID: 17674
  Gene Name: TGIF2-C20orf24 readthrough
  ENSP ID: ENSP00000454021
MSDSDLGEDEGLLSLAGKRKRRGNLPKESVKILRDWLYLHRYNAYPSEQEKLSLSGQTNLSVLQDEFLDVIYWFRQIIAVVLGVIWGVLPLRGFLGIAGFCLINAGVLYLYFSNYLQIDEEEYGGTWELTKEGFMTSFALFMVIWIIFYTAIHYD

SEQ ID NO: 88273 - protein, 257 aa, Homo sapiens
  Payload ID: 17675
  Gene Name: THAP domain containing 10
  Uniprot ID: Q9P2Z0
  ENSP ID: ENSP00000249861
MPARCVAAHCGNTTKSGKSLFRFPKDRAVRLLWDRFVRGCRADWYGGNDRSVICSDHFAPACFDVSSVIQKNLRFSQRLRLVAGAVPTLHRVPAPAPKRGEEGDQAGRLDTRGELQAARHSEAAPGPVSCTRPRAGKQAAASQITCENELVQTQPHADNPSNTVTSVPTHCEEGPVHKSTQISLKRPRHRSVGIQAKVKAFGKRLCNATTQTEELWSRTSSLFDIYSSDSETDTDWDIKSEQSDLSYMAVQVKEETC

SEQ ID NO: 88274 - protein, 127 aa, Homo sapiens
  Payload ID: 17675
  Gene Name: THAP domain containing 10
  ENSP ID: ENSP00000453920
  MOD_RES (1)..(1): Any amino acid
XVGKETIPTRSGQITCENELVQTQPHADNPSNTVTSVPTHCEEGPVHKSTQISLKRPRHRSVGIQAKVKAFGKRLCNATTQTEELWSRTSSLFDIYSSDSETDTDWDIKSEQSDLSYMAVQVKEETC

SEQ ID NO: 88275 - protein, 314 aa, Homo sapiens
  Payload ID: 17676
  Gene Name: THAP domain containing 11
  Uniprot ID: Q96EK4
  ENSP ID: ENSP00000304689
MPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRHLRLTEAKLREELREKDRLLAMAVIRKKHGM

SEQ ID NO: 88276 - protein, 192 aa, Homo sapiens
  Payload ID: 17677
  Gene Name: THAP domain containing 4
  ENSP ID: ENSP00000384352
MEPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQVSPALLPARSCLLFAAVCGVSLFLFREITRKFRLNSEGKLEQTVSMATTTQPMTQHLHVTYKKVTP

SEQ ID NO: 88277 - protein, 577 aa, Homo sapiens
  Payload ID: 17677
  Gene Name: THAP domain containing 4
  Uniprot ID: Q8WY91
  ENSP ID: ENSP00000385006
MVICCAAVNCSNRQGKGEKRAVSFHRFPLKDSKRLIQWLKAVQRDNWTPTKYSFLCSEHFTKDSFSKRLEDQHRLLKPTAVPSIFHLTEKKRGAGGHGRTRRKDASKATGGVRGHSSAATSRGAAGWSPSSSGNPMAKPESRRLKQAALQGEATPRAAQEAASQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAQSPPSSSLTATPQKPSQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 88278 - protein, 165 aa, Homo sapiens
  Payload ID: 17677
  Gene Name: THAP domain containing 4
  Uniprot ID: Q8WY91
  ENSP ID: ENSP00000385931
MEPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 88279 - protein, 169 aa, Homo sapiens [sequence omitted]

SEQ ID NO: 88280 - protein, 353 aa, Homo sapiens
  Payload ID: 17678
  Gene Name: THAP domain containing 5
  Uniprot ID: Q7Z6K1
  ENSP ID: ENSP00000322440
MKRDSWVPSKYQFLCSDHFTPDSLDIRWGIRYLKQTAVPTIFSLPEDNQGKDPSKKKSQKKNLEDEKEVCPKAKSEESFVLNETKKNIVNTDVPHQHPELLHSSSLVKPPAPKTGSIQNNMLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 88281 - protein, 395 aa, Homo sapiens
  Payload ID: 17678
  Gene Name: THAP domain containing 5
  Uniprot ID: Q7Z6K1
  ENSP ID: ENSP00000400500
MPRYCAAICCKNRRGRNNKDRKLSFYPFPLHDKERLEKWLKNMKRDSWVPSKYQFLCSDHFTPDSLDIRWGIRYLKQTAVPTIFSLPEDNQGKDPSKKKSQKKNLEDEKEVCPKAKSEESFVLNETKKNIVNTDVPHQHPELLHSSSLVKPPAPKTGSIQNNMLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 88282 - protein, 55 aa, Homo sapiens
  Payload ID: 17678
  Gene Name: THAP domain containing 5
  ENSP ID: ENSP00000415841
MPRYCAAICCKNRRGRNNKDRKLSFYPFPLHDKERLEKWLKNMKRDSWVPRKRPF

SEQ ID NO: 88283 - protein, 222 aa, Homo sapiens
  Payload ID: 17679
  Gene Name: THAP domain containing 6
  Uniprot ID: Q8TBB0
  ENSP ID: ENSP00000309007
MVKCCSAIGCASRCLPNSKLKGLTFHVFPTDENIKRKWVLAMKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFEHSYSVMDSPKKLKHKLDHVIGELEDTKESLRNVLDREKRFQKSLRKTIRELKDECLISQETANRLDTFCWDCCQESIEQDYIS

SEQ ID NO: 88284 - protein, 180 aa, Homo sapiens
  Payload ID: 17679
  Gene Name: THAP domain containing 6
  Uniprot ID: Q8TBB0
  ENSP ID: ENSP00000370217
MVKCCSAIGCASRCLPNSKLKGLTFHVFPTDENIKRKWVLAMKRLDVNAAGIWEPKKGDVLCSRHFKKTDFDRSAPNIKLKPGVIPSIFDSPYHLQEHSYSVMDSPKKLKHKLDHVIGELEDTKESLRNVLDREKRFQKSLRKTIRELKDECLISQETANRLDTFCWDCCQESIEQDYIS

SEQ ID NO: 88285 - protein, 80 aa, Homo sapiens
  Payload ID: 17679
  Gene Name: THAP domain containing 6
  ENSP ID: ENSP00000422402
MVKCCSAIGCASRCLPNSKLKGLTFHVFPTDENIKRKWVLAMKRLDVNAAGIWEPKKGDVLCSRHFKKTDFDRSAPNIKL

SEQ ID NO: 88286 - protein, 222 aa, Homo sapiens; identical to SEQ ID NO: 88283
  Payload ID: 17679
  Gene Name: THAP domain containing 6
  Uniprot ID: Q8TBB0
  ENSP ID: ENSP00000423720

SEQ ID NO: 88287 - protein, 119 aa, Homo sapiens
  Payload ID: 17679
  Gene Name: THAP domain containing 6
  ENSP ID: ENSP00000424255
MKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFKHRKRKQEQEEEQKPRREKCIS

SEQ ID NO: 88288 - protein, 89 aa, Homo sapiens
  Payload ID: 17679
  Gene Name: THAP domain containing 6
  ENSP ID: ENSP00000424949
MKRLDVNAAGIWEPKKGDVLCSRHFKKTDFDRSAPNIKLKPGVIPSIFDSPYHLQISMFKRKCLFKAKNYFSVTIIANIYKVPIFIQST

SEQ ID NO: 88289 - protein, 32 aa, Homo sapiens
  Payload ID: 17679
  Gene Name: THAP domain containing 6
  ENSP ID: ENSP00000425646
MVKCCSAIGCASRCLPNSKLKGLTFHVFPTDE

SEQ ID NO: 88290 - protein, 77 aa, Homo sapiens
  Payload ID: 17679
  Gene Name: THAP domain containing 6
  ENSP ID: ENSP00000426581
MKRLDVNAAGIWEPKKGDVLCSRHFKKTDFDRSAPNIKLKPGVIPSIFDSPYHLQKHRKRKQEQEEEQKPRREKCIS

SEQ ID NO: 88291 - protein, 98 aa, Homo sapiens
  Payload ID: 17679
  Gene Name: THAP domain containing 6
  ENSP ID: ENSP00000426698
MKRLDVNAAGIWEPKKGDVLCSRHFKKTDFDRSAPNIKLKPGVIPSIFDSPYHLQISMFKRKCLFKAKNYFSVTIIANIYKGLTLSPRLMCSGTISSL

SEQ ID NO: 88292 - protein, 111 aa, Homo sapiens
  Payload ID: 17679
  Gene Name: THAP domain containing 6
  ENSP ID: ENSP00000426760
MKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFVSKLLAELMLILLR

SEQ ID NO: 88293 - protein, 160 aa, Homo sapiens
  Payload ID: 17679
  Gene Name: THAP domain containing 6
  Uniprot ID: Q8TBB0
  ENSP ID: ENSP00000427651
MVKCCSAIGCASRCLPNSKLKGLTFHVFPTDENIKRKWVLAMKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFKHRKRKQEQEEEQKPRREKCIS

SEQ ID NO: 88294 - protein, 309 aa, Homo sapiens
  Payload ID: 17680
  Gene Name: THAP domain containing 7
  Uniprot ID: Q9BT49
  ENSP ID: ENSP00000215742
MPRHCSAAGCCTRDTRETRNRGISFHRLPKKDNPRRGLWLANCQRLDPSGQGLWDPASEYIYFCSKHFEEDCFELVGISGYHRLKEGAVPTIFESFSKLRRTTKTKGHSYPPGPAEVSRLRRCRKRCSEGRGPTTPFSPPPPADVTCFPVEEASAPATLPASPAGRLEPGLSSPFSDLLGPLGAQADEAGCSAQPSPERQPSPLEPRPVSPSAYMLRLPPPAGAYIQNEHSYQVGSALLWKRRAEAALDALDKAQRQLQACKRREQRLRLRLTKLQQERAREKRAQADARQTLKEHVQDFAMQLSSSMA

SEQ ID NO: 88295 - protein, 309 aa, Homo sapiens; identical to SEQ ID NO: 88294
  Payload ID: 17680
  Gene Name: THAP domain containing 7
  Uniprot ID: Q9BT49
  ENSP ID: ENSP00000382084

SEQ ID NO: 88296 - protein, 274 aa, Homo sapiens
  Payload ID: 17681
  Gene Name: THAP domain containing 8
  Uniprot ID: Q8NA92
  ENSP ID: ENSP00000292894
MPKYCRAPNCSNTAGRLGADNRPVSFYKFPLKDGPRLQAWLQHMGCEHWVPSCHQHLCSEHFTPSCFQWRWGVRYLRPDAVPSIFSRGPPAKSQRRTRSTQKPVSPPPPLQKNTPLPQSPAIPVSGPVRLVVLGPTSGSPKTVATMLLTPLAPAPTPERSQPEVPAQQAQTGLGPVLGALQRRVRRLQRCQERHQAQLQALERLAQQLHGESLLARARRGLQRLTTAQTLGPEESQTFTIICGGPDIAMVLAQDPAPATVDAKPELLDTRIPSA

SEQ ID NO: 88297 - protein, 65 aa, Homo sapiens
  Payload ID: 17681
  Gene Name: THAP domain containing 8
  ENSP ID: ENSP00000429629
MPKYCRAPNCSNTAGRLGADNRPVSFYKVSGGPEAPRSQSRRRLPYRRIHPCPRALPSQSLAQCA

SEQ ID NO: 88298 - protein, 41 aa, Homo sapiens
  Payload ID: 17681
  Gene Name: THAP domain containing 8
  ENSP ID: ENSP00000475450
MPKYCRAPNCSNTAGRLGADNRPVPTEGWSPAAGLAAAHGL

SEQ ID NO: 88299 - protein, 903 aa, Homo sapiens
  Payload ID: 17682
  Gene Name: THAP domain containing 9
  Uniprot ID: Q9H5L6
  ENSP ID: ENSP00000305533
MTRSCSAVGCSTRDTVLSRERGLSFHQFPTDTIQRSKWIRAVNRVDPRSKKIWIPGPGAILCSKHFQESDFESYGIRRKLKKGAVPSVSLYKIPQGVHLKGKARQKILKQPLPDNSQEVATEDHNYSLKTPLTIGAEKLAEVQQMLQVSKKRLISVKNYRMIKKRKGLRLIDALVEEKLLSEETECLLRAQFSDFKWELYNWRETDEYSAEMKQFACTLYLCSSKVYDYVRKILKLPHSSILRTWLSKCQPSPGFNSNIFSFLQRRVENGDQLYQYCSLLIKSMPLKQQLQWDPSSHSLQGFMDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALEYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHINLFVDVNKHLFDGEVCAINHFVKLLKDIIICFLNIRAKNVAQNPLKHHSERTDMKTLSRKHWSSVQDYKCSSFANTSSKFRHLLSNDGYPFK

SEQ ID NO: 88300 - protein, 30 aa, Homo sapiens
  Payload ID: 17682
  Gene Name: THAP domain containing 9
  ENSP ID: ENSP00000423622
MTRSCSAVGCSTRDTVLSRERGLSFHHVYL

SEQ ID NO: 88301 - protein, 121 aa, Homo sapiens
  Payload ID: 17682
  Gene Name: THAP domain containing 9
  ENSP ID: ENSP00000424001
SLKTPLTIGAEKLAEVQQMLQVSKKRLISVKNYRMIKKRKGLRLIDALVEEKLLSEETECLLRAQFSDFKWELYNWRETDEYSAEMKQFACTLYLCSSKVYDYVRKILKLPHSSILRTSGQ

SEQ ID NO: 88302 - protein, 102 aa, Homo sapiens
  Payload ID: 17682
  Gene Name: THAP domain containing 9
  ENSP ID: ENSP00000425503
MTRSCSAVGCSTRDTVLSRERGLSFHQFPTDTIQRSKWIRAVNRVDPRSKKIWIPGPGAILCSKHFQESDFESYGIRRKLKKGAVPSVSLYKVFKYSSRCTS

SEQ ID NO: 88303 - protein, 102 aa, Homo sapiens
  Payload ID: 17682
  Gene Name: THAP domain containing 9
  ENSP ID: ENSP00000425966
MTRSCSAVGCSTRDTVLSRERGLSFHQFPTDTIQRSKWIRAVNRVDPRSKKIWIPGPGAILCSKHFQESDFESYGIRRKLKKGAVPSVSLYKMRTQGIVELM

SEQ ID NO: 88304 - protein, 109 aa, Homo sapiens
  Payload ID: 17682
  Gene Name: THAP domain containing 9
  ENSP ID: ENSP00000426750
MTRSCSAVGCSTRDTVLSRERGLSFHQFPTDTIQRSKWIRAVNRVDPRSKKIWIPGPGAILCSKHFQESDFESYGIRRKLKKGAVPSVSLYKVFKYEDTRDCRAYVTAN

SEQ ID NO: 88305 - protein, 213 aa, Homo sapiens
  Payload ID: 17683
  Gene Name: THAP domain containing, apoptosis associated protein 1
  Uniprot ID: Q9NVV9
  ENSP ID: ENSP00000254250
MVQSCSAYGCKNRYDKDKPVSFHKFPLTRPSLCKEWEAAVRRKNFKPTKYSSICSEHFTPDCFKRECNNKLLKENAVPTIFLCTEPHDKKEDLLEPQEQLPPPPLPPPVSQVDAAIGLLMPPLQTPVNLSVFCDHNYTVEDTMHQRKRIHQLEQQVEKLRKKLKTAQQRCRRQERQLEKLKEVVHFQKEKDDVSERGYVILPNDYFEIVEVPA

SEQ ID NO: 88306 - protein, 53 aa, Homo sapiens
  Payload ID: 17683
  Gene Name: THAP domain containing, apoptosis associated protein 1
  Uniprot ID: Q9NVV9
  ENSP ID: ENSP00000344966
MVQSCSAYGCKNRYDKDKPVSFHKKKIFWSHRNSFPHLLYRLLFPRLMLLLDY

SEQ ID NO: 88307 - protein, 118 aa, Homo sapiens
  Payload ID: 17683
  Gene Name: THAP domain containing, apoptosis associated protein 1
  ENSP ID: ENSP00000433912
MVQSCSAYGCKNRYDKDKPVSFHKFPLTRPSLCKEWEAAVRRKNFKPTKYSSICSEHFTPDCFKRECNNKLLKENAVPTIFLCTEPHDKTPVNLSVFCDHNYTVEDTMHQRKRIHQLE

SEQ ID NO: 88308 - protein, 228 aa, Homo sapiens
  Payload ID: 17684
  Gene Name: THAP domain containing, apoptosis associated protein 2
  Uniprot ID: Q9H0W7
  ENSP ID: ENSP00000310796
MPTNCAAAGCATTYNKHINISFHRFPLDPKRRKEWVRLVRRKNFVPGKHTFLCSKHFEASCFDLTGQTRRLKMDAVPTIFDFCTHIKSMKLKSRNLLKKNNSCSPAGPSNLKSNISSQQVLLEHSYAFRNPMEAKKRIIKLEKEIASLRRKMKTCLQKERRATRRWIKATCLVKNLEANSVLPKGTSEHMLPTALSSLPLEDFKILEQDQQDKTLLSLNLKQTKSTFI

SEQ ID NO: 88309 - protein, 101 aa, Homo sapiens
  Payload ID: 17684
  Gene Name: THAP domain containing, apoptosis associated protein 2
  ENSP ID: ENSP00000446986
MDAVPTIFDFCTHIKSMKLKSRNLLKKNNSCSPAGPSNLKSNISSQQVLLEHSYAFRNPMEAKKRIIKLEKEIASLRRKMKTCLQKERRATRRWIKATCLV

SEQ ID NO: 88310 - protein, 110 aa, Homo sapiens
  Payload ID: 17684
  Gene Name: THAP domain containing, apoptosis associated protein 2
  ENSP ID: ENSP00000448904
MDAVPTIFDFCTHIKSMKLKSRNLLKKNNSCSPAGPSNLKSNISSQQVLLEHSYAFRNPMEAKKRIIKLEKEIASLRRKMKTCLQKERRATRRWIKATCLVKNLEANSVL

SEQ ID NO: 88311 - protein, 52 aa, Homo sapiens
  Payload ID: 17684
  Gene Name: THAP domain containing, apoptosis associated protein 2
  ENSP ID: ENSP00000449826
MPTNCAAAGCATTYNKHINISFHRPGLDMNDAVREKEIFPISNHRKSLLCSR

SEQ ID NO: 88312 - protein, 239 aa, Homo sapiens
  Payload ID: 17685
  Gene Name: THAP domain containing, apoptosis associated protein 3
  Uniprot ID: Q8WTV1
  ENSP ID: ENSP00000054650
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKVLPEAGAGEDSPGRNMDTALEELQLPPNAEGHVKQVSPRRPQATEAVGRPTGPAGLRRTPNKQPSDHSYALLDLDSLKKKLFLTLKENEKLRKRLQAQRLVMRRMSSRLRACKGHQGLQARLGPEQQS

SEQ ID NO: 88313 - protein, 238 aa, Homo sapiens
  Payload ID: 17685
  Gene Name: THAP domain containing, apoptosis associated protein 3
  Uniprot ID: Q8WTV1
  ENSP ID: ENSP00000311537
MPKSCAARQCCNRYSSRRKQLTFHRFPFSRPELLKEWVLNIGRGNFKPKQHTVICSEHFRPECFSAFGNRKNLKHNAVPTVFAFQDPTQVRENTDPASERGNASSSQKEKVLPEAGAGEDSPGRNMDTALEELQLPPNAEGHVKQVSPRRPQATEAVGRPTGPAGLRRTPNKQPSDHSYALLDLDSLKKKLFLTLKENEKLRKRLQAQRLVMRRMSSRLRACKGHQGLQARLGPEQQS

SEQ ID NO: 88314 - protein, 175 aa, Homo sapiens
  Payload ID: 17685
  Gene Name: THAP domain containing, apoptosis associated protein 3
  Uniprot ID: Q8WTV1
  ENSP ID: ENSP00000366854
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKTSPCRSQVLPEAGAGEDSPGRNMDTALEELQLPPNAEGHVKQAMLFNVENGTPASREALWLSEE

SEQ ID NO: 88315 - protein, 124 aa, Homo sapiens
  Payload ID: 17685
  Gene Name: THAP domain containing, apoptosis associated protein 3
  ENSP ID: ENSP00000464954
KSCAARQCCNRYSSRRKQLTFHRFPFSRPELLKEWVLNIGRGNFKPKQHTVICSEHFRPECFSAFGNRKNLKHNAVPTVFAFQDPTQNLHEGRGCLPCFRPHTQDAAWHSPGARAGEGEHRPCQ

SEQ ID NO: 88316 - protein, 231 aa, Homo sapiens
  Payload ID: 17685
  Gene Name: THAP domain containing, apoptosis associated protein 3
  ENSP ID: ENSP00000473646
  MOD_RES (1)..(1): Any amino acid
XCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKVLPEAGAGEDSPGRNMDTALEELQLPPNAEGHVKQVRLSAKVVCGWTQDDLLQTKWKPVSTHHETCVAEAGCAAWVSELPSQILHHGVGTSGFWGSSPECLAALGLCCVRVWWPAHHGPPSCW

SEQ ID NO: 88317 - protein, 355 aa, Homo sapiens
  Payload ID: 17686
  Gene Name: theg spermatid protein
  Uniprot ID: Q9P2T0
  ENSP ID: ENSP00000264820
MGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRPSVYWTERFLEDTTLTITVPAVSRRVEELSRPKRFYLEYYNNNRTTPVWPIPRSSLEYRASSRLKELAAPKIRDNFWSMPMSEVSQVSRAAQMAVPSSRILQLSKPKAPATLLEEWDPVPKPKPHVSDHNRLLHLARPKAQSDKCVPDRDPRWEVLDVTKKVVASPRIISLAKPKVRKGLNEGYDRRPLASMSLPPPKASPEKCDQPRPGL

SEQ ID NO: 88318 - protein, 379 aa, Homo sapiens
  Payload ID: 17686
  Gene Name: theg spermatid protein
  Uniprot ID: Q9P2T0
  ENSP ID: ENSP00000340088
MGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRKGRCGKGYAWISPCKMSLHFCLCWPSVYWTERFLEDTTLTITVPAVSRRVEELSRPKRFYLEYYNNNRTTPVWPIPRSSLEYRASSRLKELAAPKIRDNFWSMPMSEVSQVSRAAQMAVPSSRILQLSKPKAPATLLEEWDPVPKPKPHVSDHNRLLHLARPKAQSDKCVPDRDPRWEVLDVTKKVVASPRIISLAKPKVRKGLNEGYDRRPLASMSLPPPKASPEKCDQPRPGL

SEQ ID NO: 88319 - protein, 137 aa, Homo sapiens
  Payload ID: 17686
  Gene Name: theg spermatid protein
  ENSP ID: ENSP00000475782
MTKARKRRRRRRLMELAEPKINWQVLKDRCPRYPGQPKWQSPARGSSSCQSRRPQPPSWKSGTPCQNPSHMCQTITASFTWPGPKLSRTSAFLTEILAGRCWMSPRRWWPAPGSSPWPSPKCARASTRDTTGVPSPL

SEQ ID NO: 88320 - protein, 465 aa, Homo sapiens
  Payload ID: 17687
  Gene Name: theg spermatid protein-like
  Uniprot ID: P0DJG4
  ENSP ID: ENSP00000456850
MENQEFLSSSAPSEVTDGQVSTEISTCSEVFQKPIVLRILDTHRELEESEDPEKHENPEEPEEVREQDQRDESEECDEPHESYEPHAPYAPHKPRDSYAPYELHGPHAAPKLLKAREPRQLRHTREPRKSREAKETELLPSAAVMISPSLITRAPPRPQLSFLGANPVSCDFVRKCFSSRKRTPNLSKPKKQWGTPDRKLFWGNQDPIRPVSQGALKAQLTKRLENLAQPKEVSCHYVPNRAQYYHSCGRESVIWEITPPALFRQPSKRIQRLSQPNGFKRQCLLNRPFSDNSARDSLRISDPSPRILQLSVAKGTDPNYHPSKKMQTKISLSTLSAIATPRIIELAHPRIKLEGLCYERQRSELPIRPVPPAAMIAKPSPRTIALAKSKSVHQDYLPDRDAHWPVSYATTHSKASPRIQELANPNKRAPVRIVYYDPDVFKTKPAALKAQCSQRIWELSQPLTR

SEQ ID NO: 88321 - protein, 243 aa, Homo sapiens [sequence omitted]

SEQ ID NO: 88322 - protein, 121 aa, Homo sapiens
  Payload ID: 17688
  Gene Name: thiamin pyrophosphokinase 1
  ENSP ID: ENSP00000367338
MEHAFTPLEPLLSTGNLKYCLVILNQPLDNYFRHLWNKALLRACADGGANRLYDITEGERESFLPEFINGDFDSIRPEVREYYATKGCELISTPDQDHTDFTKCLKMLQKKIEEKDLKKKQ

SEQ ID NO: 88323 - protein, 194 aa, Homo sapiens
  Payload ID: 17688
  Gene Name: thiamin pyrophosphokinase 1
  ENSP ID: ENSP00000367339
MEHAFTPLEPLLSTGNLKYCLVILNQPLDNYFRHLWNKALLRACADGGANRLYDITEGERESFLPEFINGDFDSIRPEVREYYATKGCELISTPDQDHTDFTKCLKMLQKKIEEKDLKGKHRLHVDTGMEGDWCGLIPVGQPCMQVTTTGLKWNLTNDVLAFGTLVSTSNTYDGSGVVTVETDHPLLWTMAIKS

SEQ ID NO: 88324 - protein, 189 aa, Homo sapiens
  Payload ID: 17688
  Gene Name: thiamin pyrophosphokinase 1
  ENSP ID: ENSP00000438813
MEVPTAYMISPKEREKASNLKLSSRPPATSHLIRTPKDTHYCGASKGLGNSFIGNESFLPEFINGDFDSIRPEVREYYATKGCELISTPDQDHTDFTKCLKMLQKKIEEKDLKGKHRLHVDTGMEGDWCGLIPVGQPCMQVTTTGLKWNLTNDVLAFGTLVSTSNTYDGSGVVTVETDHPLLWTMAIKS

SEQ ID NO: 88325 - protein, 166 aa, Homo sapiens
  Payload ID: 17688
  Gene Name: thiamin pyrophosphokinase 1
  ENSP ID: ENSP00000448655
MEHAFTPLEPLLSTGNLKYCLVILNQPLDNYFRHLWNKALLRACADGGANRLYDITEGERESFLPEFINGDFDSIRPEVREYYATKGCELISTPDQDHTDFTKCLKMLQKKIEEKDLKVDVIVTLGGLAGRFDQIMASVNTLFQATHITPFPIIIIQEESLIYLLQ

SEQ ID NO: 88326 - protein, 79 aa, Homo sapiens
  Payload ID: 17688
  Gene Name: thiamin pyrophosphokinase 1
  ENSP ID: ENSP00000449909
MEVPTAYMISPKEREKDSSDSILQDLTWTMCEKALNLQLETLLEAPSHQSSHQDTERHPLLWSFQGSWQLFYRKRELFA

SEQ ID NO: 88327 - protein, 42 aa, Homo sapiens
  Payload ID: 17688
  Gene Name: thiamin pyrophosphokinase 1
  ENSP ID: ENSP00000450028
MEVPTAYMISPKEREKAFCLNSSMETLILLGLKSENTMLLRC

SEQ ID NO: 88328 - protein, 230 aa, Homo sapiens
  Payload ID: 17689
  Gene Name: thiamine triphosphatase
  Uniprot ID: Q9BU02
  ENSP ID: ENSP00000288014
MAQGLIEVERKFLPGPGTEERLQELGGTLEYRVTFRDTYYDTPELSLMQADHWLRRREDSGWELKCPGAAGVLGPHTEYKELTAEPTIVAQLCKVLRADGLGAGDVAAVLGPLGLQEVASFVTKRSAWKLVLLGADEEEPQLRVDLDTADFGYAVGEVEALVHEEAEVPTALEKIHRLSSMLGVPAQETAPAKLIVYLQRFRPQDYQRLLEVNSSRERPQETEDPDHCLG

SEQ ID NO: 88329 - protein, 230 aa, Homo sapiens; identical to SEQ ID NO: 88328
  Payload ID: 17689
  Gene Name: thiamine triphosphatase
  Uniprot ID: Q9BU02
  ENSP ID: ENSP00000384580

SEQ ID NO: 88330 - protein, 105 aa, Homo sapiens
  Payload ID: 17689
  Gene Name: thiamine triphosphatase
  Uniprot ID: Q9BU02
  ENSP ID: ENSP00000450459
MAQGLIEVERKFLPGPGTEERLQELGGTLEYRVTFRDTYYDTPELSLMQADHWLRRREDSGWELKCPGAAGVLGPHTEYKELTAEPTIVAQLCKVCLHRRQHQPS

SEQ ID NO: 88331 - protein, 105 aa, Homo sapiens; identical to SEQ ID NO: 88330
  Payload ID: 17689
  Gene Name: thiamine triphosphatase
  Uniprot ID: Q9BU02
  ENSP ID: ENSP00000451835

SEQ ID NO: 88332 - protein, 60 aa, Homo sapiens
  Payload ID: 17689
  Gene Name: thiamine triphosphatase
  ENSP ID: ENSP00000452164
  MOD_RES (1)..(1): Any amino acid
XLTAEPTIVAQLCVPAQETAPAKLIVYLQRFRPQDYQRLLEVNSSRERPQETEDPDHCLG

SEQ ID NO: 88333 - protein, 122 aa, Homo sapiens
  Payload ID: 17689
  Gene Name: thiamine triphosphatase
  ENSP ID: ENSP00000452281
MAQGLIEVERKFLPGPGTEERLQELGGTLEYRVTFRDTYYDTPELSLMQADHWLRRREDSGWELKCPGAAGVLGPHTEYKELTAEPTIVAQLCKVLRADGLGAGDVAAVLGPLGLQEVASFV

SEQ ID NO: 88334 - protein, 140 aa, Homo sapiens
  Payload ID: 17689
  Gene Name: thiamine triphosphatase
  ENSP ID: ENSP00000452465
MAQGLIEVERKFLPGPGTEERLQELGGTLEYRVTFRDTYYDTPELSLMQADHWLRRREDSGWELKCPGAAGVLGPHTEYKELTAEPTIVAQLCVPAQETAPAKLIVYLQRFRPQDYQRLLEVNSSRERPQETEDPDHCLG

SEQ ID NO: 88335 - protein, 689 aa, Homo sapiens
  Payload ID: 17690
  Gene Name: thimet oligopeptidase 1
  Uniprot ID: P52888
  ENSP ID: ENSP00000304467
MKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 88336 - protein, 258 aa, Homo sapiens
  Payload ID: 17690
  Gene Name: thimet oligopeptidase 1
  Uniprot ID: P52888
  ENSP ID: ENSP00000378638
MFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKFPHYEVRPLRHVSLCLPLTWCDPGSGQPPESLTRNRWLPALRAGPALPGCNIALGSLQVGMDYRSCILRPGGSEDASAMLRRFLGRDPKQDAFLLSKGLQVGGCEPEPQVC

SEQ ID NO: 88337 - protein, 169 aa, Homo sapiens
  Payload ID: 17690
  Gene Name: thimet oligopeptidase 1
  ENSP ID: ENSP00000464786
MFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAML

SEQ ID NO: 88338 - protein, 176 aa, Homo sapiens
  Payload ID: 17690
  Gene Name: thimet oligopeptidase 1
  ENSP ID: ENSP00000465545
MADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDT

SEQ ID NO: 88339 - protein, 260 aa, Homo sapiens
  Payload ID: 17690
  Gene Name: thimet oligopeptidase 1
  ENSP ID: ENSP00000465855
  MOD_RES (1)..(1): Any amino acid
XEGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 88340 - protein, 216 aa, Homo sapiens
  Payload ID: 17690
  Gene Name: thimet oligopeptidase 1
  ENSP ID: ENSP00000465895
ADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKEAPHWPLRPRAVSAGSSVSSHTSPSGICVIGLRAMG

SEQ ID NO: 88341 - protein, 204 aa, Homo sapiens
  Payload ID: 17690
  Gene Name: thimet oligopeptidase 1
  ENSP ID: ENSP00000466653
  MOD_RES (1)..(1): Any amino acid
XGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIGLVFVALTRLLSGKRPLSGDGSSLK

SEQ ID NO: 88342 - protein, 568 aa, Homo sapiens
  Payload ID: 17690
  Gene Name: thimet oligopeptidase 1
  ENSP ID: ENSP00000467226
MFLFQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 88343 - protein, 240 aa, Homo sapiens
  Payload ID: 17691
  Gene Name: thioesterase superfamily member 4
  Uniprot ID: Q5T1C6
  ENSP ID: ENSP00000357804
MLRSCAARLRTLGALCLPPVGRRLPGSEPRPELRSFSSEEVILKDCSVPNPSWNKDLRLLFDQFMKKCEDGSWKRLPSYKRTPTEWIQDFKTHFLDPKLMKEEQMSQAQLFTRSFDDGLGFEYVMFYNDIEKRMVCLFQGGPYLEGPPGFIHGGAIATMIDATVGMCAMMAGGIVMTANLNINYKRPIPLCSVVMINSQLDKVEGRKFFVSCNVQSVDEKTLYSEATSLFIKLNPAKSLT

SEQ ID NO: 88344 - protein, 107 aa, Homo sapiens
  Payload ID: 17691
  Gene Name: thioesterase superfamily member 4
  ENSP ID: ENSP00000431288
MLRSCAARLRTLGALCLPPVGRRLPGSEPRPELRSFSSEEVILKDCSVPNPSWNKDLRLLFDQFMKKCEDGSWKRLPSYKRTPTEWIQDFKTHFLAWLMAGRCGSRL

SEQ ID NO: 88345 - protein, 110 aa, Homo sapiens
  Payload ID: 17691
  Gene Name: thioesterase superfamily member 4
  ENSP ID: ENSP00000433304
MLRSCAARLRTLGALCLPPVGRRLPGSEPRPELRSFSSEEVILKDCSVPNPSWNKDLRLLFDQFMKKCEDGSWKRLPSYKRTPTEWIQDFKTHFLGRNSHFPINISEHQI

SEQ ID NO: 88346 - protein, 247 aa, Homo sapiens
  Payload ID: 17692
  Gene Name: thioesterase superfamily member 5
  Uniprot ID: Q8N1Q8
  ENSP ID: ENSP00000357807
MIRRCFQVAARLGHHRGLLEAPRILPRLNPASAFGSSTDSMFSRFLPEKTDLKDYALPNASWCSDMLSLYQEFLEKTKSSGWIKLPSFKSNRDHIRGLKLPSGLAVSSDKGDCRIFTRCIQVEGQGFEYVIFFQPTQKKSVCLFQPGSYLEGPPGFAHGGSLAAMMDETFSKTAFLAGEGLFTLSLNIRFKNLIPVDSLVVMDVELDKIEDQKLYMSCIAHSRDQQTVYAKSSGVFLQLQLEEESPQ

SEQ ID NO: 88347 - protein, 119 aa, Homo sapiens
  Payload ID: 17692
  Gene Name: thioesterase superfamily member 5
  ENSP ID: ENSP00000406809
  MOD_RES (1)..(1): Any amino acid
XCIQVEGQGFEYVIFFQPTQKKSVCLFQPGSYLEGPPGFAHGGSLAAMMDETFSKTAFLAGEGLFTLSLNIRFKKCFPSAAVGRRVSPVTVTVPAGEPLPPLPASCLLPPLPASCLLPP

SEQ ID NO: 88348 - protein, 208 aa, Homo sapiens
  Payload ID: 17693
  Gene Name: thioesterase superfamily member 6
  Uniprot ID: Q8WUY1
  ENSP ID: ENSP00000338607
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRVEPPELPADLQHWISYNEASSQLLRMESGLSDVTKDQ

SEQ ID NO: 88349 - protein, 83 aa, Homo sapiens
  Payload ID: 17693
  Gene Name: thioesterase superfamily member 6
  ENSP ID: ENSP00000427970
  MOD_RES (1)..(1): Any amino acid
XDDRAFYLEARFVSLRDGFVCALLRFRQHLLGTSPERVVQHLCQRRVEPPELPADLQHWISYNEASSQLLRMESGLSDVTKDQ

SEQ ID NO: 88350 - protein, 245 aa, Homo sapiens
  Payload ID: 17694
  Gene Name: thiopurine S-methyltransferase
  Uniprot ID: P51580
  ENSP ID: ENSP00000312304
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPGPPFYVPHAEIERLFGKICNIRCLEKVDAFEERHKSWGIDCLFEKLYLLTEK

SEQ ID NO: 88351 - protein, 85 aa, Homo sapiens
  Payload ID: 17695
  Gene Name: thioredoxin
  Uniprot ID: P10599
  ENSP ID: ENSP00000363639
MVKQIESKTAFQEALDAAGDKLVVVDFSATWCGPCKMIKPFFHDVASECEVKCMPTFQFFKKGQKVGEFSGANKEKLEATINELV

SEQ ID NO: 88352 - protein, 105 aa, Homo sapiens
  Payload ID: 17695
  Gene Name: thioredoxin
  Uniprot ID: P10599
  ENSP ID: ENSP00000363641
MVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 88353 - protein, 166 aa, Homo sapiens
  Payload ID: 17696
  Gene Name: thioredoxin 2
  Uniprot ID: Q99757
  ENSP ID: ENSP00000216185
MAQRLLLRRFLASVISRKPSQGQWPPLTSRALQTPQCSPGGLTVTPNPARTIYTTRISLTTFNIQDGPDFQDRVVNSETPVVVDFHAQWCGPCKILGPRLEKMVAKQHGKVVMAKVDIDDHTDLAIEYEVSAVPTVLAMKNGDVVDKFVGIKDEDQLEAFLKKLIG

SEQ ID NO: 88354 - protein, 166 aa, Homo sapiens; identical to SEQ ID NO: 88353
  Payload ID: 17696
  Gene Name: thioredoxin 2
  Uniprot ID: Q99757
  ENSP ID: ENSP00000385393

SEQ ID NO: 88355 - protein, 146 aa, Homo sapiens
  Payload ID: 17696
  Gene Name: thioredoxin 2
  ENSP ID: ENSP00000409407
MAQRLLLRRFLASVISRKPSQGQWPPLTSRALQTPQCSPGGLTVTPNPARTIYTTRISLTTFNIQDGPDFQDRVVNSETPVVVDFHAQWCGPCKILGPRLEKMVAKQHGKVVMAKVDIDDHTDLAIEYEAGSLSPRLECSGTITAH

SEQ ID NO: 88356 - protein, 64 aa, Homo sapiens
  Payload ID: 17696
  Gene Name: thioredoxin 2
  ENSP ID: ENSP00000469160
MVAKQHGKVVMAKVDIDDHTDLAIEYEVSAVPTVLAMKNGDVVDKFVGIKDEDQLEAFLKKLIG

SEQ ID NO: 88357 - protein, 958 aa, Homo sapiens
  Payload ID: 17697
  Gene Name: thioredoxin domain containing 11
  Uniprot ID: Q6PKC3
  ENSP ID: ENSP00000283033
MSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLESFIQNFSVLYSPLKRHLIGSGSAQFPSQHLITEVTTDTFWEVVLQKQDVLLLYYAPWCGFCPSLNHIFIQLARNLPMDTFTVARIDVSQNDLPWEFMVDRLPTVLFFPCNRKDLSVKYPEDVPITLPNLLRFILHHSDPASSPQNVANSPTKECLQSEAVLQRGHISHLEREIQKLRAEISSLQRAQVQVESQLSSARRDEHRLRQQQRALEEQHSLLHAHSEQLQALYEQKTRELQELARKLQELADASENLLTENTWLKILVATMERKLEGRDGAESLAAQREVHPKQPEPSATPQLPGSSPPPANVSATLVSERNKENRTD

SEQ ID NO: 88358 - protein, 985 aa, Homo sapiens
  Payload ID: 17697
  Gene Name: thioredoxin domain containing 11
  Uniprot ID: Q6PKC3
  ENSP ID: ENSP00000349439
MSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKALESTSSPRALVSFTGEWHLETKIYVLDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLESFIQNFSVLYSPLKRHLIGSGSAQFPSQHLITEVTTDTFWEVVLQKQDVLLLYYAPWCGFCPSLNHIFIQLARNLPMDTFTVARIDVSQNDLPWEFMVDRLPTVLFFPCNRKDLSVKYPEDVPITLPNLLRFILHHSDPASSPQNVANSPTKECLQSEAVLQRGHISHLEREIQKLRAEISSLQRAQVQVESQLSSARRDEHRLRQQQRALEEQHSLLHAHSEQLQALYEQKTRELQELARKLQELADASENLLTENTWLKILVATMERKLEGRDGAESLAAQREVHPKQPEPSATPQLPGSSPPPANVSATLVSERNKENRTD

SEQ ID NO: 88359 - protein, 205 aa, Homo sapiens
  Payload ID: 17697
  Gene Name: thioredoxin domain containing 11
  ENSP ID: ENSP00000458263
YVRRDSEVVLLFFYAPWCGQSIAARAEIEQAASRLSDQPGVLGYFEFSGSPQPPGYLTFFTSALHSLKKDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPV

SEQ ID NO: 88360 - protein, 147 aa, Homo sapiens
  Payload ID: 17697
  Gene Name: thioredoxin domain containing 11
  ENSP ID: ENSP00000458687
RPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSLEYSGTLSSVAHPSLLVI

SEQ ID NO: 88361 - protein, 25 aa, Homo sapiens
  Payload ID: 17697
  Gene Name: thioredoxin domain containing 11
  ENSP ID: ENSP00000460058
  MOD_RES (1)..(1): Any amino acid
XYLYHRSLEYSGTLSSVAHPSLLVI

SEQ ID NO: 88362 - protein, 172 aa, Homo sapiens
  Payload ID: 17698
  Gene Name: thioredoxin domain containing 12 (endoplasmic reticulum)
  Uniprot ID: O95881
  ENSP ID: ENSP00000360688
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 88363 - protein, 55 aa, Homo sapiens
  Payload ID: 17698
  Gene Name: thioredoxin domain containing 12 (endoplasmic reticulum)
  ENSP ID: ENSP00000476401
METRPRLGATCLLGFSFLLLVISSDGHNGLGKGFGDHIHWRTLEDGKKEAAARPY

SEQ ID NO: 88364 - protein, 56 aa, Homo sapiens
  Payload ID: 17698
  Gene Name: thioredoxin domain containing 12 (endoplasmic reticulum)
  ENSP ID: ENSP00000477120
METRPRLGATCLLGFSFLLLVISSDGHNGLGKGFGDHIHWRTLEDGKKEAAARIHV

SEQ ID NO: 88365 - protein, 360 aa, Homo sapiens
  Payload ID: 17699
  Gene Name: thioredoxin domain containing 15
  Uniprot ID: Q96J42
  ENSP ID: ENSP00000351157
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 88366 - protein, 115 aa, Homo sapiens
  Payload ID: 17699
  Gene Name: thioredoxin domain containing 15
  ENSP ID: ENSP00000422832
  MOD_RES (1)..(1): Any amino acid
XLALDASQHSRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 88367 - protein, 344 aa, Homo sapiens
  Payload ID: 17699
  Gene Name: thioredoxin domain containing 15
  ENSP ID: ENSP00000423513
  MOD_RES (1)..(1): Any amino acid
XFPGVSWMEAGQQRVVEKVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 88368 - protein, 44 aa, Homo sapiens
  Payload ID: 17699
  Gene Name: thioredoxin domain containing 15
  ENSP ID: ENSP00000423609
MVPAAGRRPPRVMRLLGWWQVLLWVLGLPVRGVEGPYGFSEPKR

SEQ ID NO: 88369 - protein, 155 aa, Homo sapiens
  Payload ID: 17699
  Gene Name: thioredoxin domain containing 15
  ENSP ID: ENSP00000424220
MVPAAGRRPPRVMRLLGWWQVLLWVLGLPVRGVEEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESD

SEQ ID NO: 88370 - protein, 179 aa, Homo sapiens
  Payload ID: 17699
  Gene Name: thioredoxin domain containing 15
  ENSP ID: ENSP00000424428
MKNRRETRETPGNPQLAVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMS

SEQ ID NO: 88371 - protein, 44 aa, Homo sapiens
  Payload ID: 17699
  Gene Name: thioredoxin domain containing 15
  ENSP ID: ENSP00000424716
MVPAAGRRPPRVMRLLGWCCRGKWSLMVRGAACSPSPGGGCVPG

SEQ ID NO: 88372 - protein, 825 aa, Homo sapiens
  Payload ID: 17700
  Gene Name: thioredoxin domain containing 16
  Uniprot ID: Q9P2K2
  ENSP ID: ENSP00000281741
MFSGFNVFRVGISFVIMCIFYMPTVNSLPELSPQKYFSTLQPGKASLAYFCQADSPRTSVFLEELNEAVRPLQDYGISVAKVNCVKEEISRYCGKEKDLMKAYLFKGNILLREFPTDTLFDVNAIVAHVLFALLFSEVKYITNLEDLQNIENALKGKANIIFSYVRAIGIPEHRAVMEAAFVYGTTYQFVLTTEIALLESIGSEDVEYAHLYFFHCKLVLDLTQQCRRTLMEQPLTTLNIHLFIKTMKAPLLTEVAEDPQQVSTVHLQLGLPLVFIVSQQATYEADRRTAEWVAWRLLGKAGVLLLLRDSLEVNIPQDANVVFKRAEEGVPVEFLVLHDVDLIISHVENNMHIEEIQEDEDNDMEGPDIDVQDDEVAETVFRDRKRKLPLELTVELTEETFNATVMASDSIVLFYAGWQAVSMAFLQSYIDVAVKLKGTSTMLLTRINCADWSDVCTKQNVTEFPIIKMYKKGENPVSYAGMLGTEDLLKFIQLNRISYPVNITSIQEAEEYLSGELYKDLILYSSVSVLGLFSPTMKTAKEDFSEAGNYLKGYVITGIYSEEDVLLLSTKYAASLPALLLARHTEGKIESIPLASTHAQDIVQIITDALLEMFPEITVENLPSYFRLQKPLLILFSDGTVNPQYKKAILTLVKQKYLDSFTPCWLNLKNTPVGRGILRAYFDPLPPLPLLVLVNLHSGGQVFAFPSDQAIIEENLVLWLKKLEAGLENHITILPAQEWKPPLPAYDFLSMIDAATSQRGTRKVPKCMKETDVQENDKEQHEDKSAVRKEPIETLRIKHWNRSNWFKEAEKSFRRDKELGCSKVN

SEQ ID NO: 88373 - protein, 19 aa, Homo sapiens
  Payload ID: 17700
  Gene Name: thioredoxin domain containing 16
  ENSP ID: ENSP00000450839
MHIEEIQEDEDNDMEGPDI

SEQ ID NO: 88374 - protein, 107 aa, Homo sapiens
  Payload ID: 17700
  Gene Name: thioredoxin domain containing 16
  ENSP ID: ENSP00000451619
  MOD_RES (1)..(1): Any amino acid
XTMLLTRINCADWSDVCTKQNVTEFPIIKMYKKGENPVSYAGMLGTEDLLKFIQLNRISYPVNITSIQEAEEYLSGELYKDLILYSSVSVLGLFSPTMKTGRKKVND

SEQ ID NO: 88375 - protein, 123 aa, Homo sapiens
  Payload ID: 17701
  Gene Name: thioredoxin domain containing 17
  Uniprot ID: Q9BRA2
  ENSP ID: ENSP00000250101
MARYEEVSVSGFEEFHRAVEQHNGKTIFAYFTGSKDAGGKSWCPDCVQAEPVVREGLKHISEGCVFIYCQVGEKPYWKDPNNDFRKNLKVTAVPTLLKYGTPQKLVESECLQANLVEMLFSED

SEQ ID NO: 88376 - protein, 75 aa, Homo sapiens
  Payload ID: 17701
  Gene Name: thioredoxin domain containing 17
  ENSP ID: ENSP00000458157
MARYEEVSVSGFEEFHRAVEQHNGKTIFAYFTGSKDAGGKSWCPDCVQAEPVVREGLKHISEGCVFIYCQVGEKP

SEQ ID NO: 88377 - protein, 98 aa, Homo sapiens
  Payload ID: 17701
  Gene Name: thioredoxin domain containing 17
  ENSP ID: ENSP00000459868
MARYEEVSVSGFEEFHRAVEQHNAEPVVREGLKHISEGCVFIYCQVGEKPYWKDPNNDFRKNLKVTAVPTLLKYGTPQKLVESECLQANLVEMLFSED

SEQ ID NO: 88378 - protein, 80 aa, Homo sapiens
  Payload ID: 17701
  Gene Name: thioredoxin domain containing 17
  ENSP ID: ENSP00000460577
MARYEEVSVSGFEEFHRAVEQHNGKTIFAYFTGSKDAGGKSWCPDCVQAEPVVREGLKHISEGCVFIYCQVGEKPYLKNW

SEQ ID NO: 88379 - protein, 553 aa, Homo sapiens
  Payload ID: 17702
  Gene Name: thioredoxin domain containing 2 (spermatozoa)
  Uniprot ID: Q86VQ3
  ENSP ID: ENSP00000304908
MDVDKELGMESVKAGASGKPEMRLGTQEETSEGDANESSLLVLSSNVPLLALEFLEIAQAKEKAFLPMVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 88380 - protein, 486 aa, Homo sapiens
  Payload ID: 17702
  Gene Name: thioredoxin domain containing 2 (spermatozoa)
  Uniprot ID: Q86VQ3
  ENSP ID: ENSP00000350419
MVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 88381 - protein, 110 aa, Homo sapiens
  Payload ID: 17702
  Gene Name: thioredoxin domain containing 2 (spermatozoa)
  ENSP ID: ENSP00000437393
MVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEG

SEQ ID NO: 88382 - protein, 83 aa, Homo sapiens
  Payload ID: 17702
  Gene Name: thioredoxin domain containing 2 (spermatozoa)
  ENSP ID: ENSP00000464677
MVSHTFHMRTEESDASQEGDDLPKSSANTSHPKQDDSPKSSEETIQPKEGDIPKAPEETIQSKKEDLPKSSEKAIQPKESNIP

SEQ ID NO: 88383 - protein, 538 aa, Homo sapiens
  Payload ID: 17702
  Gene Name: thioredoxin domain containing 2 (spermatozoa)
  Uniprot ID: Q86VQ3
  ENSP ID: ENSP00000483261
MDVDKELGMESVKAGASGKPEMRLGTQEETSEGDANESSLLVLSSNVPLLALEFLEIAQAKEKAFLPMVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 88384 - protein, 432 aa, Homo sapiens
  Payload ID: 17703
  Gene Name: thioredoxin domain containing 5 (endoplasmic reticulum)
  Uniprot ID: Q8NBS9
  ENSP ID: ENSP00000369081
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 88385 - protein, 324 aa, Homo sapiens
  Payload ID: 17703
  Gene Name: thioredoxin domain containing 5 (endoplasmic reticulum)
  Uniprot ID: Q8NBS9
  ENSP ID: ENSP00000420784
MEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 88386 - protein, 108 aa, Homo sapiens
  Payload ID: 17704
  Gene Name: thioredoxin domain containing 8 (spermatozoa)
  ENSP ID: ENSP00000363631
MVQIIKDTNEFKTFLTAAGHKLAVVQFSSKRCGPCKRMFPVFHELAETCHIKTIPTFQMFKKSQKGSISRPTPTSELHPHQKWTLDSSQANPSQTRANFRTLLKQLGK

SEQ ID NO: 88387 - protein, 115 aa, Homo sapiens
  Payload ID: 17704
  Gene Name: thioredoxin domain containing 8 (spermatozoa)
  Uniprot ID: Q6A555
  ENSP ID: ENSP00000363634
MVQIIKDTNEFKTFLTAAGHKLAVVQFSSKRCGPCKRMFPVFHAMSVKYQNVFFANVDVNNSPELAETCHIKTIPTFQMFKKSQKVTLFSRIKRIICCYRSGFMSNLCLADDGNE

SEQ ID NO: 88388 - protein, 127 aa, Homo sapiens
  Payload ID: 17704
  Gene Name: thioredoxin domain containing 8 (spermatozoa)
  Uniprot ID: Q6A555
  ENSP ID: ENSP00000363635
MVQIIKDTNEFKTFLTAAGHKLAVVQFSSKRCGPCKRMFPVFHAMSVKYQNVFFANVDVNNSPELAETCHIKTIPTFQMFKKSQKVTLFSRIKRIICCYRSGFMSNLIFEFCGADAKKLEAKTQELM

SEQ ID NO: 88389 - protein, 95 aa, Homo sapiens
  Payload ID: 17704
  Gene Name: thioredoxin domain containing 8 (spermatozoa)
  ENSP ID: ENSP00000408768
MVQIIKDTNEFKTFLTAAGHKLAVVQFSSKRCGPCKRMFPVFHELAETCHIKTIPTFQMFKKSQKVTLFSRIKRIICCYRSGFMSNLCLADDGNE

SEQ ID NO: 88390 - protein, 226 aa, Homo sapiens
  Payload ID: 17705
  Gene Name: thioredoxin domain containing 9
  Uniprot ID: O14530
  ENSP ID: ENSP00000264255
MEADASVDMFSKVLEHQLLQTTKLVEEHLDSEIQKLDQMDEDELERLKEKRLQALRKAQQQKQEWLSKGHGEYREIPSERDFFQEVKESENVVCHFYRDSTFRCKILDRHLAILSKKHLETKFLKLNVEKAPFLCERLHIKVIPTLALLKDGKTQDYVVGFTDLGNTDDFTTETLEWRLGSSDILNYSGNLMEPPFQNQKKFGTNFTKLEKKTIRGKKYDSDSDDD

SEQ ID NO: 88391 - protein, 135 aa, Homo sapiens
  Payload ID: 17705
  Gene Name: thioredoxin domain containing 9
  ENSP ID: ENSP00000386889
MEADASVDMFSKVLEHQLLQTTKLVEEHLDSEIQKLDQMDEDELERLKEKRLQALRKAQQQKQEWLSKGHGEYREIPSERDFFQEVKESENVVCHFYRDSTFRCKILDRHLAILSKKHLETKFLKLNVEKAPFLC

SEQ ID NO: 88392 - protein, 188 aa, Homo sapiens
  Payload ID: 17705
  Gene Name: thioredoxin domain containing 9
  Uniprot ID: O14530
  ENSP ID: ENSP00000387275
MEADASVDMFSKVLEHQLLQTTKLVEEHLDSEIQKLDQMDEDELERLKEKRLQALRKAQQQKQEWLSKGHGEYREIPSERDFFQEVKESENVVCHFYRDSTFRCKILDRHLAILSKKHLETKFLKLNVEKAPFLCERLHIKVIPTLALLKDGKTQDYVVGFTDLGNTDDFTTETLEWRLGSSDILNYR

SEQ ID NO: 88393 - protein, 64 aa, Homo sapiens
  Payload ID: 17705
  Gene Name: thioredoxin domain containing 9
  ENSP ID: ENSP00000391046
MEADASVDMFSKVLEHQLLQTTKLVEEHLDSEIQKLDQMDEDELERLKEKRLQALRKAQQQKQV

SEQ ID NO: 88394 - protein, 74 aa, Homo sapiens
  Payload ID: 17705
  Gene Name: thioredoxin domain containing 9
  ENSP ID: ENSP00000402827
MEADASVDMFSKVLEHQLLQTTKLVEEHLDSEIQKLDQMDEDELERLKEKRLQALRKAQQQKQVTSLPCFLKLL

SEQ ID NO: 88395 - protein, 122 aa, Homo sapiens
  Payload ID: 17705
  Gene Name: thioredoxin domain containing 9
  ENSP ID: ENSP00000406388
MEADASVDMFSKVLEHQLLQTTKLVEEHLDSEIQKLDQMDEDELERLKEKRLQALRKAQQQKQEWLSKGHGEYREIPSERDFFQEVKESENVVCHFYRDSTFSVAYLGVRSFSSVMLFSFSS

SEQ ID NO: 88396 - protein, 336 aa, Homo sapiens
  Payload ID: 17706
  Gene Name: thioredoxin interacting protein
  Uniprot ID: Q9H3M7
  ENSP ID: ENSP00000396322
MPPKHSLSHRCILSVTASLMATRFSFPSGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 88397 - protein, 391 aa, Homo sapiens
  Payload ID: 17706
  Gene Name: thioredoxin interacting protein
  Uniprot ID: Q9H3M7
  ENSP ID: ENSP00000462521
MVMFKKIKSFEVVFNDPEKVYGSGEKVAGRVIVEVCEVTRVKAVRILACGVAKVLWMQGSQQCKQTSEYLRYEDTLLLEDQPTGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 88398 - protein, 498 aa, Homo sapiens
  Payload ID: 17707
  Gene Name: thioredoxin reductase 1
  ENSP ID: ENSP00000347020
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCG

SEQ ID NO: 88399 - protein, 548 aa, Homo sapiens
  Payload ID: 17707
  Gene Name: thioredoxin reductase 1
  ENSP ID: ENSP00000373506
MEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCG

SEQ ID NO: 88400 - protein, 460 aa, Homo sapiens
  Payload ID: 17707
  Gene Name: thioredoxin reductase 1
  ENSP ID: ENSP00000380844
MVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCG

SEQ ID NO: 88401 - protein, 648 aa, Homo sapiens
  Payload ID: 17707
  Gene Name: thioredoxin reductase 1
  ENSP ID: ENSP00000412045
MGCAEGKAVAAAAPTELQTKGKNGDGRRRSAKDHHPGKTLPENPAGFTSTATADSRALLQAYIDGHSVVIFSRSTCTRCTEVKKLFKSLCVPYFVLELDQTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCG

SEQ ID NO: 88402 - protein, 499 aa, Homo sapiens
  Payload ID: 17707
  Gene Name: thioredoxin reductase 1
  Uniprot ID: Q16881
  ENSP ID: ENSP00000421934
  MOD_RES (498)..(498): Selenocysteine
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 88403 - protein, 70 aa, Homo sapiens
  Payload ID: 17707
  Gene Name: thioredoxin reductase 1
  ENSP ID: ENSP00000431294
MNGPEDLPKSYDYDLIIIGGGSGGLAAAKEAAQYGKKVMVLDFVTPTPLGTRWGLGGTCVNVGCIPKKLM

SEQ ID NO: 88404 - protein, 139 aa, Homo sapiens
  Payload ID: 17707
  Gene Name: thioredoxin reductase 1
  ENSP ID: ENSP00000431925
MLSRLVLNSWAQAIIRPRPPKVLGLQVTTFSEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETGM

SEQ ID NO: 88405 - protein, 44 aa, Homo sapiens
  Payload ID: 17707
  Gene Name: thioredoxin reductase 1
  ENSP ID: ENSP00000432273
MLAIGRDACTRKIGLETVGVKINEKTGKIPVTDEEQTNVPYIYA

SEQ ID NO: 88406 - protein, 568 aa, Homo sapiens
  Payload ID: 17707
  Gene Name: thioredoxin reductase 1
  ENSP ID: ENSP00000432812
  MOD_RES (567)..(567): Selenocysteine
MPAMLPTGSHSAVLPPSHCSTAPPSTSQEPSSSADPKLCLSPPTSDSRQERNVQFGLAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 88407 - protein, 499 aa, Homo sapiens; identical to SEQ ID NO: 88402
  Payload ID: 17707
  Gene Name: thioredoxin reductase 1
  Uniprot ID: Q16881
  ENSP ID: ENSP00000433425
  MOD_RES (498)..(498): Selenocysteine

SEQ ID NO: 88408 - protein, 72 aa, Homo sapiens
  Payload ID: 17707
  Gene Name: thioredoxin reductase 1
  ENSP ID: ENSP00000433507
MNGPEDLPKSYDYDLIIIGGGSGGLAAAKEAAQYGKKVMVLDFVTPTPLGTRWGLGGTCVNVGCIPKKLMHQ

SEQ ID NO: 88409 - protein, 175 aa, Homo sapiens
  Payload ID: 17707
  Gene Name: thioredoxin reductase 1
  ENSP ID: ENSP00000433599
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKE

SEQ ID NO: 88410 - protein, 96 aa, Homo sapiens
  Payload ID: 17707
  Gene Name: thioredoxin reductase 1
  ENSP ID: ENSP00000433732
MPAMLPTGSHSAVLPPSHCSTAPPSTSQEPSSSADPKLCLSPPTSDSRQERNVQFGLAYQEGRLQKLLKMNGPEDLPKSYDYDLIIIGGGSGGLAA

SEQ ID NO: 88411 - protein, 103 aa, Homo sapiens
  Payload ID: 17707
  Gene Name: thioredoxin reductase 1
  ENSP ID: ENSP00000433887
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIE

SEQ ID NO: 88412 - protein, 482 aa, Homo sapiens
  Payload ID: 17707
  Gene Name: thioredoxin reductase 1
  ENSP ID: ENSP00000433935
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEFFSFI

SEQ ID NO: 88413 - protein, 649 aa, Homo sapiens
  Payload ID: 17707
  Gene Name: thioredoxin reductase 1
  Uniprot ID: Q16881
  ENSP ID: ENSP00000434516
  MOD_RES (648)..(648): Selenocysteine
MGCAEGKAVAAAAPTELQTKGKNGDGRRRSAKDHHPGKTLPENPAGFTSTATADSRALLQAYIDGHSVVIFSRSTCTRCTEVKKLFKSLCVPYFVLELDQTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 88414 - protein, 461 aa, Homo sapiens
  Payload ID: 17707
  Gene Name: thioredoxin reductase 1
  Uniprot ID: Q16881
  ENSP ID: ENSP00000434919
  MOD_RES (460)..(460): Selenocysteine
MVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 88415 - protein, 543 aa, Homo sapiens
  Payload ID: 17707
  Gene Name: thioredoxin reductase 1
  Uniprot ID: Q16881
  ENSP ID: ENSP00000435123
  MOD_RES (542)..(542): Selenocysteine
MLSRLVLNSWAQAIIRPRPPKVLGLQVTTFSEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 88416 - protein, 551 aa, Homo sapiens
  Payload ID: 17707
  Gene Name: thioredoxin reductase 1
  Uniprot ID: Q16881
  ENSP ID: ENSP00000435929
  MOD_RES (550)..(550): Selenocysteine
MSCEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 88417 - protein, 53 aa, Homo sapiens
  Payload ID: 17707
  Gene Name: thioredoxin reductase 1
  ENSP ID: ENSP00000436229
MNGPEDLPKSYDYDLIIIGGGSGGLAAAKEAAQYGKKVMVLDFVTPTPLGTRW

SEQ ID NO: 88418 - protein, 338 aa, Homo sapiens
  Payload ID: 17708
  Gene Name: thioredoxin reductase 2
  ENSP ID: ENSP00000334451
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIAPCISACLPTTVGHAGKNQRRD

SEQ ID NO: 88419 - protein, 494 aa, Homo sapiens
  Payload ID: 17708
  Gene Name: thioredoxin reductase 2
  ENSP ID: ENSP00000383362
  MOD_RES (493)..(493): Selenocysteine
MEDQAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXG

SEQ ID NO: 88420 - protein, 523 aa, Homo sapiens
  Payload ID: 17708
  Gene Name: thioredoxin reductase 2
  ENSP ID: ENSP00000383363
  MOD_RES (522)..(522): Selenocysteine
MAAMAVALRGLGGRFRWRTQAVAGGVRGAARGAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXG

SEQ ID NO: 88421 - protein, 524 aa, Homo sapiens
  Payload ID: 17708
  Gene Name: thioredoxin reductase 2
  Uniprot ID: Q9NNW7
  ENSP ID: ENSP00000383365
  MOD_RES (523)..(523): Selenocysteine
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXG

SEQ ID NO: 88422 - protein, 501 aa, Homo sapiens
  Payload ID: 17708
  Gene Name: thioredoxin reductase 2
  ENSP ID: ENSP00000383369
  MOD_RES (500)..(500): Selenocysteine
MAAMAVALRGLGGRFRWRTQAVAGGVRGAARGAAAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXG

SEQ ID NO: 88423 - protein, 428 aa, Homo sapiens
  Payload ID: 17708
  Gene Name: thioredoxin reductase 2
  ENSP ID: ENSP00000485128
  MOD_RES (427)..(427): Selenocysteine
MHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXG

SEQ ID NO: 88424 - protein, 171 aa, Homo sapiens
  Payload ID: 17708
  Gene Name: thioredoxin reductase 2
  ENSP ID: ENSP00000485290
  MOD_RES (1)..(1): Any amino acid
XGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGLPHPAGCQAGWPLPSAPREQP

SEQ ID NO: 88425 - protein, 212 aa, Homo sapiens
  Payload ID: 17708
  Gene Name: thioredoxin reductase 2
  ENSP ID: ENSP00000485466
  MOD_RES (173)..(173): Selenocysteine
MPLRRTSSRGNAGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXGMAAGQVWGASTLSWSACEMVSVERKCWTGGPCAPQGWL

SEQ ID NO: 88426 - protein, 180 aa, Homo sapiens
  Payload ID: 17708
  Gene Name: thioredoxin reductase 2
  ENSP ID: ENSP00000485499
  MOD_RES (179)..(179): Selenocysteine
MKTVAGALLSLVMGQPSEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXG

SEQ ID NO: 88427 - protein, 306 aa, Homo sapiens
  Payload ID: 17708
  Gene Name: thioredoxin reductase 2
  ENSP ID: ENSP00000485543
MEAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIAPCISACLPTTVGHAGKNQRRD

SEQ ID NO: 88428 - protein, 165 aa, Homo sapiens
  Payload ID: 17708
  Gene Name: thioredoxin reductase 2
  ENSP ID: ENSP00000485603
  MOD_RES (164)..(164): Selenocysteine
MKTGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXG

SEQ ID NO: 88429 - protein, 463 aa, Homo sapiens
  Payload ID: 17708
  Gene Name: thioredoxin reductase 2
  ENSP ID: ENSP00000485665
MAAMAVALRGLGGRFRWRTQAVAGGVRGAARGAAAGQRDYDLLVVGGGSGGLACAKEGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIK

SEQ ID NO: 88430 - protein, 362 aa, Homo sapiens
  Payload ID: 17708
  Gene Name: thioredoxin reductase 2
  ENSP ID: ENSP00000489208
  MOD_RES (266)..(266): Selenocysteine
QQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCXGMAAGQVWGASTLSWSACEMVSVERKCWTGGPCAPQGWLRGLSTSPLHLSASAAGHPPPGSWCQMMTTWVETYPVGTHVRAPWHFCNANKEGTFSE

SEQ ID NO: 88431 - protein, 133 aa, Homo sapiens
  Payload ID: 17709
  Gene Name: thioredoxin reductase 3
  ENSP ID: ENSP00000373066
MRDLSERRLGQPELKAEQQMPLEPVRARLSVGLACCCSHTTAEASSLEHGDKVFGQGFPSPLEEIKRLLKISRALQARSVPSTQEKAKCLSGEPGQPEGKGQETYPGPGKVEGKAEPAMRKDDVCPGMKCISG

SEQ ID NO: 88432 - protein, 41 aa, Homo sapiens
  Payload ID: 17709
  Gene Name: thioredoxin reductase 3
  ENSP ID: ENSP00000427753
  MOD_RES (40)..(40): Selenocysteine
GLTKQLLDDTIGIHPTCGEVFTTLEITKSSGLDITQKGCXG

SEQ ID NO: 88433 - protein, 607 aa, Homo sapiens
  Payload ID: 17709
  Gene Name: thioredoxin reductase 3
  ENSP ID: ENSP00000429584
  MOD_RES (606)..(606): Selenocysteine
LERSPPQSPGPGKAGDAPNRRSGHVRGARVLSPPGRRARLSSPGPSRSSEAREELRRHLVGLIERSRVVIFSKSYCPHSTRVKELFSSLGVECNVLELDQVDDGARVQEVLSEITNQKTVPNIFVNKVHVGGCDQTFQAYQSGLLQKLLQEDLAYDYDLIIIGGGSGGLSCAKEAAILGKKVMVLDFVVPSPQGTSWGLGGTCVNVGCIPKKLMHQAALLGQALCDSRKFGWEYNQQVRHNWETMTKAIQNHISSLNWGYRLSLREKAVAYVNSYGEFVEHHKIKATNKKGQETYYTAAQFVIATGERPRYLGIQGDKEYCITSDDLFSLPYCPGKTLVVGASYVALECAGFLAGFGLDVTVMVRSILLRGFDQEMAEKVGSYMEQHGVKFLRKFIPVMVQQLEKGSPGKLKVLAKSTEGTETIEGVYNTVLLAIGRDSCTRKIGLEKIGVKINEKSGKIPVNDVEQTNVPYVYAVGDILEDKPELTPVAIQSGKLLAQRLFGASLEKIYHTLFWPLEWTVAGRENNTCYAKIICNKFDHDRVIGFHILGPNAGEVTQGFAAAMKCGLTKQLLDDTIGIHPTCGEVFTTLEITKSSGLDITQKGCXG

SEQ ID NO: 88434 - protein, 643 aa, Homo sapiens
  Payload ID: 17709
  Gene Name: thioredoxin reductase 3
  ENSP ID: ENSP00000430031
  MOD_RES (642)..(642): Selenocysteine
LERSPPQSPGPGKAGDAPNRRSGHVRGARVLSPPGRRARLSSPGPSRSSEAREELRRHLVGLIERSRVVIFSKSYCPHSTRVKELFSSLGVECNVLELDQVDDGARVQEVLSEITNQKTVPNIFVNKVHVGGCDQTFQAYQSGLLQKLLQEDLAYDYDLIIIGGGSGGLSCAKEAAILGKKVMVLDFVVPSPQGTSWGLGGTCVNVGCIPKKLMHQAALLGQALCDSRKFGWEYNQQVRHNWETMTKAIQNHISSLNWGYRLSLREKAVAYVNSYGEFVEHHKIKATNKKGQETYYTAAQFVIATGERPRYLGIQGDKEYCITSDDLFSLPYCPGKTLVVGASYVALECAGFLAGFGLDVTVMVRSILLRGFDQEMAEKVGSYMEQHGVKFLRKFIPVMVQQLEKGSPGKLKVLAKSTEGTETIEGVYNTVLLAIGRDSCTRKIGLEKIGVKINEKSGKIPVNDVEQTNVPYVYAVGDILEDKPELTPVAIQSGKLLAQRLFGASLEKCDYINVPTTVFTPLEYGCCGLSEEKAIEVYKKENLEIYHTLFWPLEWTVAGRENNTCYAKIICNKFDHDRVIGFHILGPNAGEVTQGFAAAMKCGLTKQLLDDTIGIHPTCGEVFTTLEITKSSGLDITQKGCXG

SEQ ID NO: 88435 - protein, 83 aa, Homo sapiens
  Payload ID: 17709
  Gene Name: thioredoxin reductase 3
  ENSP ID: ENSP00000430605
  MOD_RES (82)..(82): Selenocysteine
MHRYRGKRLHILLPILDRVIGFHILGPNAGEVTQGFAAAMKCGLTKQLLDDTIGIHPTCGEVFTTLEITKSSGLDITQKGCXG

SEQ ID NO: 88436 - protein, 133 aa, Homo sapiens; identical to SEQ ID NO: 88431
  Payload ID: 17710
  Gene Name: thioredoxin reductase 3 neighbor
  Uniprot ID: Q6F5E7
  ENSP ID: ENSP00000384071

SEQ ID NO: 88437 - protein, 289 aa, Homo sapiens
  Payload ID: 17711
  Gene Name: thioredoxin-like 1
  Uniprot ID: O43396
  ENSP ID: ENSP00000217515
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVVGKKGESH

SEQ ID NO: 88438 - protein, 289 aa, Homo sapiens; identical to SEQ ID NO: 88437
  Payload ID: 17711
  Gene Name: thioredoxin-like 1
  Uniprot ID: O43396
  ENSP ID: ENSP00000464918

SEQ ID NO: 88439 - protein, 27 aa, Homo sapiens
  Payload ID: 17711
  Gene Name: thioredoxin-like 1
  ENSP ID: ENSP00000465606
MVGVKPVGSDPDFQPELSGAGSRLAVV

SEQ ID NO: 88440 - protein, 103 aa, Homo sapiens
  Payload ID: 17711
  Gene Name: thioredoxin-like 1
  ENSP ID: ENSP00000466473
  MOD_RES (1)..(1): Any amino acid
XDIKEDGIVPLRYVKFQNVNSVTIFVQSNQGEEETTRISYFTFIGTPVQATNMNDFKRHLSALTLPMFSPLLVQDFYSFYHLDQPCYLENTHWQVESYQPVKQ

SEQ ID NO: 88441 - protein, 138 aa, Homo sapiens
  Payload ID: 17711
  Gene Name: thioredoxin-like 1
  ENSP ID: ENSP00000466558
MLRKFTLLTPSHCFPLRCKRCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLR

SEQ ID NO: 88442 - protein, 69 aa, Homo sapiens
  Payload ID: 17711
  Gene Name: thioredoxin-like 1
  ENSP ID: ENSP00000467317
MVGVKPVGSDPDFQPELSGAGSRLAVVKFTMRGCGPCLRIAPAFSSMSNKYPQAVFLEVDVHQCQYLFL

SEQ ID NO: 88443 - protein, 281 aa, Homo sapiens
  Payload ID: 17711
  Gene Name: thioredoxin-like 1
  ENSP ID: ENSP00000468165
  MOD_RES (1)..(1): Any amino acid
XPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVSLLK

SEQ ID NO: 88444 - protein, 142 aa, Homo sapiens
  Payload ID: 17712
  Gene Name: thioredoxin-like 4A
  Uniprot ID: P83876
  ENSP ID: ENSP00000269601
MSYMLPHLHNGWQVDQAILSEEDRVVVIRFGHDWDPTCMKMDEVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 88445 - protein, 91 aa, Homo sapiens
  Payload ID: 17712
  Gene Name: thioredoxin-like 4A
  ENSP ID: ENSP00000347678
MSYMLPHLHNGWQVDQAILSEEDRVVVIRFGHDWDPTCMKMDEVLYSIAEKVKNFAVIYLVDITEVPDFNKMYELYDPCTVMFFFSYHRGW

SEQ ID NO: 88446 - protein, 57 aa, Homo sapiens
  Payload ID: 17712
  Gene Name: thioredoxin-like 4A
  ENSP ID: ENSP00000465321
MSYMLPHLHNGWQVDQAILSEEDRVVVIRFGHDWDPTCMKMDEVLYSIAEKEQAHHD

SEQ ID NO: 88447 - protein, 71 aa, Homo sapiens
  Payload ID: 17712
  Gene Name: thioredoxin-like 4A
  ENSP ID: ENSP00000465493
MYELYDPCTVMFFFRNKHIMIDLGTGNNNKINWAMEDKQEMVDIIETVYRGARKGRGLVVSPKDYSTKYRY

SEQ ID NO: 88448 - protein, 71 aa, Homo sapiens; identical to SEQ ID NO: 88447
  Payload ID: 17712
  Gene Name: thioredoxin-like 4A
  ENSP ID: ENSP00000465572

SEQ ID NO: 88449 - protein, 54 aa, Homo sapiens
  Payload ID: 17712
  Gene Name: thioredoxin-like 4A
  ENSP ID: ENSP00000466266
MSYMLPHLHNGWQVDQAILSEEDRVVVIRFGHDWDPTCMKMDEVLYSIAEKVVA

SEQ ID NO: 88450 - protein, 86 aa, Homo sapiens
  Payload ID: 17712
  Gene Name: thioredoxin-like 4A
  ENSP ID: ENSP00000466694
MSYMLPHLHNGWQVDQAILSEEDRVVVIRFGHDWDPTCMKMDEVLYSIAEKFCRLYRKCGTGICFWGGLRTFQSWQKAKGNRHVAR

SEQ ID NO: 88451 - protein, 54 aa, Homo sapiens; identical to SEQ ID NO: 88449
  Payload ID: 17712
  Gene Name: thioredoxin-like 4A
  ENSP ID: ENSP00000467304

SEQ ID NO: 88452 - protein, 103 aa, Homo sapiens
  Payload ID: 17712
  Gene Name: thioredoxin-like 4A
  ENSP ID: ENSP00000468493
MSYMLPHLHNGWQVDQAILSEEDRVVVIRFGHDWDPTCMKMDEVLYSIAEKVKNFAVIYLVDITEVPDFNKMYELYDPCTVMFFFRYVILKLLLKLNIVSLEA

SEQ ID NO: 88453 - protein, 71 aa, Homo sapiens; identical to SEQ ID NO: 88447
  Payload ID: 17712
  Gene Name: thioredoxin-like 4A
  ENSP ID: ENSP00000468761

SEQ ID NO: 88454 - protein, 149 aa, Homo sapiens
  Payload ID: 17713
  Gene Name: thioredoxin-like 4B
  Uniprot ID: Q9NX01
  ENSP ID: ENSP00000268483
MSFLLPKLTSKKEVDQAIKSTAEKVLVLRFGRDEDPVCLQLDDILSKTSSDLSKMAAIYLVDVDQTAVYTQYFDISYIPSTVFFFNGQHMKVDYGSPDHTKFVGSFKTKQDFIDLIEVIYRGAMRGKLIVQSPIDPKNIPKYDLLYQDI

SEQ ID NO: 88455 - protein, 149 aa, Homo sapiens; identical to SEQ ID NO: 88454
  Payload ID: 17713
  Gene Name: thioredoxin-like 4B
  Uniprot ID: Q9NX01
  ENSP ID: ENSP00000392310

SEQ ID NO: 88456 - protein, 149 aa, Homo sapiens; identical to SEQ ID NO: 88454
  Payload ID: 17713
  Gene Name: thioredoxin-like 4B
  Uniprot ID: Q9NX01
  ENSP ID: ENSP00000408130

SEQ ID NO: 88457 - protein, 117 aa, Homo sapiens
  Payload ID: 17713
  Gene Name: thioredoxin-like 4B
  ENSP ID: ENSP00000454635
MSFLLPKLTSKKEVDQAIKSTAEKVLVLRFGRDEDPVCLQLDDILSKTSSDLSKMAAIYLVDVDQTAVYTQYFDISYIPSTVFFFNGQHMKVDYGGEDPALRSIKAVRRTSPAGTLG

SEQ ID NO: 88458 - protein, 57 aa, Homo sapiens
  Payload ID: 17713
  Gene Name: thioredoxin-like 4B
  ENSP ID: ENSP00000455550
MSFLLPKLTSKKEVDQAIKSTAEKVLVLRFGRDEDPVCLQLDDICAASSMCLMQRET

SEQ ID NO: 88459 - protein, 94 aa, Homo sapiens
  Payload ID: 17713
  Gene Name: thioredoxin-like 4B
  ENSP ID: ENSP00000457699
MSFLLPKLTSKKEVDQAIKSTAEKVLVLRFGRDEDPVCLQLDDILSKTSSDLSKMAAIYLVDVDQTAVYTQYFDISYIPSTVFFFNGQHMKVDY

SEQ ID NO: 88460 - protein, 280 aa, Homo sapiens
  Payload ID: 17714
  Gene Name: thioredoxin-related transmembrane protein 1
  Uniprot ID: Q9H3N1
  ENSP ID: ENSP00000393316
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFALATLFSGLLLGLCMIFVADCLCPSKRRRPQPYPYPSKKLLSESAQPLKKVEEEQEADEEDVSEEEAESKEGTNKDFPQNAIRQRSLGPSLATDKS

SEQ ID NO: 88461 - protein, 105 aa, Homo sapiens
  Payload ID: 17714
  Gene Name: thioredoxin-related transmembrane protein 1
  ENSP ID: ENSP00000451585
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYQ

SEQ ID NO: 88462 - protein, 296 aa, Homo sapiens
  Payload ID: 17715
  Gene Name: thioredoxin-related transmembrane protein 2
  Uniprot ID: Q9Y320
  ENSP ID: ENSP00000278422
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 88463 - protein, 258 aa, Homo sapiens
  Payload ID: 17715
  Gene Name: thioredoxin-related transmembrane protein 2
  Uniprot ID: Q9Y320
  ENSP ID: ENSP00000367562
MAVLAPLIALVYSVPRLSRWLAQPYYLLSALLSAAFLLVRKLPPLCHGLPTQREDGNPCDFDWREVEILMFLSAIVMMKNRRSMFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 88464 - protein, 103 aa, Homo sapiens
  Payload ID: 17715
  Gene Name: thioredoxin-related transmembrane protein 2
  ENSP ID: ENSP00000431333
MAVLAPLIALVYSVPRLSRWLAQPYYLLSALLSAAFLLVRKLPPLCHGLPTQREDGNPCDFDWREVEILMFLSAIVMMKNRRSRGTRTGQEGHLDCGVLCQLV

SEQ ID NO: 88465 - protein, 115 aa, Homo sapiens
  Payload ID: 17715
  Gene Name: thioredoxin-related transmembrane protein 2
  ENSP ID: ENSP00000431695
MAVLAPLIALVYSVPRLSRWLAQPYYLLSALLSAAFLLVRKLPPLCHGLPTQREDGNPCDFDWREVEILMFLSAIVMMKNRRSMPHEEGQRMGYRSAQPSLTCDISVFQSLWSNI

SEQ ID NO: 88466 - protein, 84 aa, Homo sapiens
  Payload ID: 17715
  Gene Name: thioredoxin-related transmembrane protein 2
  ENSP ID: ENSP00000434002
MAVLAPLIALVYSVPRLSRWLAQPYYLLSALLSAAFLLVRKLPPLCHGLPTQREDGNPCDFDWREVEILMFLSAIVMMKNRRSS

SEQ ID NO: 88467 - protein, 86 aa, Homo sapiens
  Payload ID: 17715
  Gene Name: thioredoxin-related transmembrane protein 2
  ENSP ID: ENSP00000436013
MAVLAPLIALVYSVPRLSRWLAQPYYLLSALLSAAFLLVRKLPPLCHGLPTQREDGNPCDFDWREVEILMFLSAIVMMKNRRSSTK

SEQ ID NO: 88468 - protein, 115 aa, Homo sapiens; identical to SEQ ID NO: 88465
  Payload ID: 17715
  Gene Name: thioredoxin-related transmembrane protein 2
  ENSP ID: ENSP00000437023

SEQ ID NO: 88469 - protein, 103 aa, Homo sapiens; identical to SEQ ID NO: 88464
  Payload ID: 17715
  Gene Name: thioredoxin-related transmembrane protein 2
  ENSP ID: ENSP00000437257

SEQ ID NO: 88470 - protein, 454 aa, Homo sapiens
  Payload ID: 17716
  Gene Name: thioredoxin-related transmembrane protein 3
  Uniprot ID: Q96JJ7
  ENSP ID: ENSP00000299608
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVIDEKNTSVEHTRLKSIIQEVARDYRDLFHRDFQFGHMDGNDYINTLLMDELTVPTVVVLNTSNQQYFLLDRQIKNVEDMVQFINNILDGTVEAQGGDSILQRLKRIVFDAKSTIVSIFKSSPLMGCFLFGLPLGVISIMCYGIYTADTDGGYIEERYEVSKSENENQEQIEESKEQQEPSSGGSVVPTVQEPKDVLEKKKD

SEQ ID NO: 88471 - protein, 197 aa, Homo sapiens
  Payload ID: 17716
  Gene Name: thioredoxin-related transmembrane protein 3
  ENSP ID: ENSP00000402605
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLALIRPLPSQQMFEHMQKRHRVFFVYVGGESPLKEKYIDAASELIVYTYFFSASEEVVPEYVTLKEMPAVLVFKDETYFVYDGKFQIFNSCKTF

SEQ ID NO: 88472 - protein, 128 aa, Homo sapiens
  Payload ID: 17716
  Gene Name: thioredoxin-related transmembrane protein 3
  ENSP ID: ENSP00000455234
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLRFPGGLKIGVWPFFIGEIKRGLGI

SEQ ID NO: 88473 - protein, 63 aa, Homo sapiens
  Payload ID: 17716
  Gene Name: thioredoxin-related transmembrane protein 3
  ENSP ID: ENSP00000456453
MAAWKSWTALRLCATVVVLDMVVCKGFVEDLDESFKENRNDDIWLVDALLQSLEFEVIQQLSY

SEQ ID NO: 88474 - protein, 89 aa, Homo sapiens
  Payload ID: 17716
  Gene Name: thioredoxin-related transmembrane protein 3
  ENSP ID: ENSP00000456587
MAAWKSWTALRLCATVVVLDMVVCKGFVEDLDESFKENRNDDIWLVDFYAPWCGHCKKLEPIWNEVGLEMKSIGSPVKVGKMDATSYSN

SEQ ID NO: 88475 - protein, 69 aa, Homo sapiens
  Payload ID: 17716
  Gene Name: thioredoxin-related transmembrane protein 3
  ENSP ID: ENSP00000457074
MVVCKGFVEDLDESFKENRNDDIWLVDFYAPWCGHCKKLEPIWNEVGLEMKSIGSPVKVGKMDATSYSN

SEQ ID NO: 88476 - protein, 195 aa, Homo sapiens
  Payload ID: 17716
  Gene Name: thioredoxin-related transmembrane protein 3
  Uniprot ID: Q96JJ7
  ENSP ID: ENSP00000457262
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEVIFKI

SEQ ID NO: 88477 - protein, 89 aa, Homo sapiens; identical to SEQ ID NO: 88474
  Payload ID: 17716
  Gene Name: thioredoxin-related transmembrane protein 3
  ENSP ID: ENSP00000458132

SEQ ID NO: 88478 - protein, 349 aa, Homo sapiens
  Payload ID: 17717
  Gene Name: thioredoxin-related transmembrane protein 4
  Uniprot ID: Q9H1E5
  ENSP ID: ENSP00000246024
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 88479 - protein, 79 aa, Homo sapiens
  Payload ID: 17717
  Gene Name: thioredoxin-related transmembrane protein 4
  ENSP ID: ENSP00000433878
MAGGRCGPQLTALLAAWIAAVAATAGPEEAALPPEQSRVQPMTASNWTLVMEGEWMLKLYRYVLEEKGHSVTSTCSMNT

SEQ ID NO: 88480 - protein, 198 aa, Homo sapiens
  Payload ID: 17717
  Gene Name: thioredoxin-related transmembrane protein 4
  ENSP ID: ENSP00000435735
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERS

SEQ ID NO: 88481 - protein, 297 aa, Homo sapiens
  Payload ID: 17718
  Gene Name: thiosulfate sulfurtransferase (rhodanese)
  Uniprot ID: Q16762
  ENSP ID: ENSP00000249042
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGFEKGPEELRALFQTKKVDLSQPLIATCRKGVTACHVALAAYLCGKPDVAVYDGSWSEWFRRAPPESRVSQGKSEKA

SEQ ID NO: 88482 - protein, 297 aa, Homo sapiens; identical to SEQ ID NO: 88481
  Payload ID: 17718
  Gene Name: thiosulfate sulfurtransferase (rhodanese)
  Uniprot ID: Q16762
  ENSP ID: ENSP00000385828

SEQ ID NO: 88483 - protein, 124 aa, Homo sapiens
  Payload ID: 17718
  Gene Name: thiosulfate sulfurtransferase (rhodanese)
  ENSP ID: ENSP00000400764
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTV

SEQ ID NO: 88484 - protein, 297 aa, Homo sapiens; identical to SEQ ID NO: 88481
  Payload ID: 17718
  Gene Name: thiosulfate sulfurtransferase (rhodanese)
  Uniprot ID: Q16762
  ENSP ID: ENSP00000478739

SEQ ID NO: 88485 - protein, 109 aa, Homo sapiens
  Payload ID: 17719
  Gene Name: thiosulfate sulfurtransferase (rhodanese)-like domain containing 1
  Uniprot ID: Q8NFU3
  ENSP ID: ENSP00000325518
MAGAPTVSLPELRSLLASGRARLFDVRSREEAAAGTIPGALNIPVSELESALQMEPAAFQALYSAEKPKLEDEHLVFFCQMGKRGLQATQLARSLGYTGYGEVWLLAGR

SEQ ID NO: 88486 - protein, 122 aa, Homo sapiens
  Payload ID: 17719
  Gene Name: thiosulfate sulfurtransferase (rhodanese)-like domain containing 1
  Uniprot ID: Q8NFU3
  ENSP ID: ENSP00000357002
MAGGCRAPSSAPTVSLPELRSLLASGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 88487 - protein, 74 aa, Homo sapiens
  Payload ID: 17719
  Gene Name: thiosulfate sulfurtransferase (rhodanese)-like domain containing 1
  Uniprot ID: Q8NFU3
  ENSP ID: ENSP00000357003
MAGVSELESALQMEPAAFQALYSAEKPKLEDEHLVFFCQMGKRGLQATQLARSLGYTGARNYAGAYREWLEKES

SEQ ID NO: 88488 - protein, 115 aa, Homo sapiens
  Payload ID: 17719
  Gene Name: thiosulfate sulfurtransferase (rhodanese)-like domain containing 1
  Uniprot ID: Q8NFU3
  ENSP ID: ENSP00000388293
MAGAPTVSLPELRSLLASGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 88489 - protein, 62 aa, Homo sapiens
  Payload ID: 17719
  Gene Name: thiosulfate sulfurtransferase (rhodanese)-like domain containing 1
  ENSP ID: ENSP00000473633
MEPAAFQALYSAEKPKLEDEHLVFFCQMGKRGLQATQLARSLGYTGARNYAGAYREWLEKES

SEQ ID NO: 88490 - protein, 516 aa, Homo sapiens
  Payload ID: 17720
  Gene Name: thiosulfate sulfurtransferase (rhodanese)-like domain containing 2
  Uniprot ID: Q5T7W7
  ENSP ID: ENSP00000342499
MPSSTSPDQGDDLENCILRFSDLDLKDMSLINPSSSLKAELDGSTKKKYSFAKKKAFALFVKTKEVPTKRSFECKEKLWKCCRQLFTDQTSIHRHVATQHADEIYHQTASILKQLAVTLSTSKSLSSADEKNPLKECLPHSHDVSAWLPDISCFNPDELISGQGSEEGEVLLYYCYHDLEDPQWICAWQTALCQHLHLTGKIRIAAEGINGTVGGSKLATRLYVEVMLSFPLFKDDLCKDDFKTSKGGAHCFPELRVGVFEEIVPMGISPKKISYKKPGIHLSPGEFHKEVEKFLSQANQEQSDTILLDCRNFYESKIGRFQGCLAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 88491 - protein, 7 aa, Homo sapiens
  Payload ID: 17720
  Gene Name: thiosulfate sulfurtransferase (rhodanese)-like domain containing 2
  ENSP ID: ENSP00000364308
  MOD_RES (1)..(1): Any amino acid
XKKVEFL

SEQ ID NO: 88492 - protein, 59 aa, Homo sapiens
  Payload ID: 17720
  Gene Name: thiosulfate sulfurtransferase (rhodanese)-like domain containing 2
  ENSP ID: ENSP00000364315
MPSSTSPDQGDDLENCILRFSDLDLKDMSLINPSSSLKAELDGSTKKKYSFAKKKVEFL

SEQ ID NO: 88493 - protein, 657 aa, Homo sapiens
  Payload ID: 17721
  Gene Name: THO complex 1
  Uniprot ID: Q96FV9
  ENSP ID: ENSP00000261600
MSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 88494 - protein, 86 aa, Homo sapiens
  Payload ID: 17721
  Gene Name: THO complex 1
  ENSP ID: ENSP00000461943
MSPTPPLFSLPEARTRFTKSTREALNNKNIKPLLSTFSQVPGSENEKKCTLDQAFRGILEEEIINHSSCENVLAIISLAIGGVTEA

SEQ ID NO: 88495 - protein, 251 aa, Homo sapiens
  Payload ID: 17721
  Gene Name: THO complex 1
  ENSP ID: ENSP00000462757
MSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTWITSGTLCNAMRRFHGKLFSSILKKF

SEQ ID NO: 88496 - protein, 121 aa, Homo sapiens
  Payload ID: 17721
  Gene Name: THO complex 1
  ENSP ID: ENSP00000463965
MSPTPPLFSLPEARTRFTKSTREALNNKNIKPLLSTFSQVPGSENEKKCTLDQAFRGILEEEIVFVPHLHLLYCWEMFWIVFLWISVTQYSLLWKKMLLLGNQIHSILLGKITYYVCAMIS

SEQ ID NO: 88497 - protein, 272 aa, Homo sapiens
  Payload ID: 17721
  Gene Name: THO complex 1
  ENSP ID: ENSP00000473276
  MOD_RES (1)..(1): Any amino acid
XFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKESVCFVHDRTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELP

SEQ ID NO: 88498 - protein, 95 aa, Homo sapiens
  Payload ID: 17721
  Gene Name: THO complex 1
  ENSP ID: ENSP00000473499
  MOD_RES (1)..(1): Any amino acid
XEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKV

SEQ ID NO: 88499 - protein, 657 aa, Homo sapiens
  Payload ID: 17721
  Gene Name: THO complex 1
  ENSP ID: ENSP00000480460
MSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKDRTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 88500 - protein, 360 aa, Homo sapiens
  Payload ID: 17721
  Gene Name: THO complex 1
  ENSP ID: ENSP00000481599
FKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQVSSTRNKPMIEKMEI

SEQ ID NO: 88501 - protein, 121 aa, Homo sapiens; identical to SEQ ID NO: 88496
  Payload ID: 17721
  Gene Name: THO complex 1
  ENSP ID: ENSP00000486359

SEQ ID NO: 88502 - protein, 1593 aa, Homo sapiens
  Payload ID: 17722
  Gene Name: THO complex 2
  Uniprot ID: Q8NI27
  ENSP ID: ENSP00000245838
MAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYRLYGQWKNETYNSHPLLVKVKAQTIDRAKYIMKRLTKENVKPSGRQIGKLSHSNPTILFDYILSQIQKYDNLITPVVDSLKYLTSLNYDVLAYCIIEALANPEKERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 88503 - protein, 1593 aa, Homo sapiens; identical to SEQ ID NO: 88502
  Payload ID: 17722
  Gene Name: THO complex 2
  Uniprot ID: Q8NI27
  ENSP ID: ENSP00000347959

SEQ ID NO: 88504 - protein, 189 aa, Homo sapiens
  Payload ID: 17722
  Gene Name: THO complex 2
  ENSP ID: ENSP00000397317
  MOD_RES (1)..(1): Any amino acid
XEQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 88505 - protein, 84 aa, Homo sapiens
  Payload ID: 17722
  Gene Name: THO complex 2
  ENSP ID: ENSP00000402168
GVSKHKSESPCESPYPNEKDKEKNKSKSSGKEKGSDSFKSEKMDKISSGGKKESRHDKEKIEKKEKRDSSGGKEEKKQSSDKHR

SEQ ID NO: 88506 - protein, 388 aa, Homo sapiens
  Payload ID: 17722
  Gene Name: THO complex 2
  ENSP ID: ENSP00000415211
  MOD_RES (1)..(1): Any amino acid
XSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKVTAILPKVPLGSENYASSPVISIHFLQDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 88507 - protein, 180 aa, Homo sapiens
  Payload ID: 17722
  Gene Name: THO complex 2
  ENSP ID: ENSP00000415244
IDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKQSSDKHR

SEQ ID NO: 88508 - protein, 120 aa, Homo sapiens
  Payload ID: 17722
  Gene Name: THO complex 2
  ENSP ID: ENSP00000415374
MAAAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLFQTQF

SEQ ID NO: 88509 - protein, 165 aa, Homo sapiens
  Payload ID: 17722
  Gene Name: THO complex 2
  ENSP ID: ENSP00000415947
  MOD_RES (1)..(1): Any amino acid
XVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKVSIA

SEQ ID NO: 88510 - protein, 379 aa, Homo sapiens
  Payload ID: 17722
  Gene Name: THO complex 2
  ENSP ID: ENSP00000416639
  MOD_RES (1)..(1): Any amino acid
XERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGVEVYLLPSGDYGRLCDHVSTGCYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEK

SEQ ID NO: 88511 - protein, 1478 aa, Homo sapiens
  Payload ID: 17722
  Gene Name: THO complex 2
  ENSP ID: ENSP00000419795
MFVSDTVLKERLDPETLESLGLIKQSQQFNQKSVKIKTKLFYKQQKFNLLREENEGYAKLIAELGQDLSGSITSDLILENIKSLIGCFNLDPNRVLDVILEVFECRPEHDDFFISLLESYMSMCEPQTLCHILGFKFKFYQEPNGETPSSLYRVAAVLLQFNLIDLDDLYVHLLPADNCIMDEHKREIAEAKQIVRKLTMVVLSSEKMDEREKEKEKEEEKVEKPPDNQKLGLLEALLKIGDWQHAQNIMDQMPPYYAASHKLIALAICKLIHITIEPLYRRVGVPKGAKGSPVNALQNKRAPKQAESFEDLRRDVFNMFCYLGPHLSHDPILFAKVVRIGKSFMKEFQSDGSKQEDKEKTEVILSCLLSITDQVLLPSLSLMDCNACMSEELWGMFKTFPYQHRYRLYGQWKNETYNSHPLLVKVKAQTIDRAKYIMKRLTKENVKPSGRQIGKLSHSNPTILFDYILSQIQKYDNLITPVVDSLKYLTSLNYDVLAYCIIEALANPEKERMKHDDTTISSWLQSLASFCGAVFRKYPIDLAGLLQYVANQLKAGKSFDLLILKEVVQKMAGIEITEEMTMEQLEAMTGGEQLKAEGGYFGQIRNTKKSSQRLKDALLDHDLALPLCLLMAQQRNGVIFQEGGEKHLKLVGKLYDQCHDTLVQFGGFLASNLSTEDYIKRVPSIDVLCNEFHTPHDAAFFLSRPMYAHHISSKYDELKKSEKGSKQQHKVHKYITSCEMVMAPVHEAVVSLHVSKVWDDISPQFYATFWSLTMYDLAVPHTSYEREVNKLKVQMKAIDDNQEMPPNKKKKEKERCTALQDKLLEEEKKQMEHVQRVLQRLKLEKDNWLLAKSTKNETITKFLQLCIFPRCIFSAIDAVYCARFVELVHQQKTPNFSTLLCYDRVFSDIIYTVASCTENEASRYGRFLCCMLETVTRWHSDRATYEKECGNYPGFLTILRATGFDGGNKADQLDYENFRHVVHKWHYKLTKASVHCLETGEYTHIRNILIVLTKILPWYPKVLNLGQALERRVHKICQEEKEKRPDLYALAMGYSGQLKSRKSYMIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 88512 - protein, 414 aa, Homo sapiens
  Payload ID: 17722
  Gene Name: THO complex 2
  Uniprot ID: Q8NI27
  ENSP ID: ENSP00000480478
MIPENEFHHKDPPPRNAVASVQNGPGGGPSSSSIGSASKSDESSTEETDKSRERSQCGVKAVNKASSTTPKGNSSNGNSGSNSNKAVKENDKEKGKEKEKEKKEKTPATTPEARVLGKDGKEKPKEERPNKDEKARETKERTPKSDKEKEKFKKEEKAKDEKFKTTVPNAESKSTQEREREKEPSRERDIAKEMKSKENVKGGEKTPVSGSLKSPVPRSDIPEPEREQKRRKIDTHPSPSHSSTVKDSLIELKESSAKLYINHTPPPLSKSKEREMDKKDLDKSRERSREREKKDEKDRKERKRDHSNNDREVPPDLTKRRKEENGTMGVSKHKSESPCESPYPNEKDKEKNKSKSSGKEKGSDSFKSEKMDKISSGGKKESRHDKEKIEKKEKRDSSGGKEEKKHHKSSDKHR

SEQ ID NO: 88513 - protein, 351 aa, Homo sapiens
  Payload ID: 17723
  Gene Name: THO complex 3
  Uniprot ID: Q96J01
  ENSP ID: ENSP00000265097
MAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 88514 - protein, 75 aa, Homo sapiens
  Payload ID: 17723
  Gene Name: THO complex 3
  ENSP ID: ENSP00000394166
  MOD_RES (1)..(1): Any amino acid
XVSLWDVDELVCVRCFSRLDWPVRTLSFSHDGKMLASASEDHFIDIAEVETDRVSFCHPAWCAVVQAILLPQPPK

SEQ ID NO: 88515 - protein, 105 aa, Homo sapiens
  Payload ID: 17723
  Gene Name: THO complex 3
  ENSP ID: ENSP00000421082
MAVPAAAMGPSALGQSGPGSMAPWCSVSSGPSRYVLGMQELFRGHSKTREFLAHSAKVHSVAWSCDGRRLASGSFDKTASVFLLEKDRLGRTLISAGVLMGRPLL

SEQ ID NO: 88516 - protein, 327 aa, Homo sapiens
  Payload ID: 17723
  Gene Name: THO complex 3
  Uniprot ID: Q96J01
  ENSP ID: ENSP00000422243
MAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGNFMRIYRLSPLAVRTSLVISSLHVTTSPA

SEQ ID NO: 88517 - protein, 56 aa, Homo sapiens
  Payload ID: 17723
  Gene Name: THO complex 3
  ENSP ID: ENSP00000424967
  MOD_RES (1)..(1): Any amino acid
XQSINAHPSNCICIKFDPMGKYFATGSADALVSLWDVDELVCVRCFSRGQTMGGTV

SEQ ID NO: 88518 - protein, 166 aa, Homo sapiens
  Payload ID: 17723
  Gene Name: THO complex 3
  ENSP ID: ENSP00000425039
MAWLCGSLPVVVAVTAMETAARQECYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 88519 - protein, 57 aa, Homo sapiens
  Payload ID: 17723
  Gene Name: THO complex 3
  ENSP ID: ENSP00000425781
HDGKMLASASEDHFIDIAEVETVQQTHSASQKAAGPLAKRPVCSIVIIPPSLLPFES

SEQ ID NO: 88520 - protein, 55 aa, Homo sapiens
  Payload ID: 17723
  Gene Name: THO complex 3
  ENSP ID: ENSP00000427029
VVVAVTAMETAARQEWSKKTIIGDMGIVWTSFVGIQVILTYLLRRPEIKPFASGM

SEQ ID NO: 88521 - protein, 13 aa, Homo sapiens
  Payload ID: 17723
  Gene Name: THO complex 3
  ENSP ID: ENSP00000427267
VAVTAMETAARQE

SEQ ID NO: 88522 - protein, 105 aa, Homo sapiens; identical to SEQ ID NO: 88515
  Payload ID: 17723
  Gene Name: THO complex 3
  ENSP ID: ENSP00000487428

SEQ ID NO: 88523 - protein, 683 aa, Homo sapiens
  Payload ID: 17724
  Gene Name: THO complex 5
  Uniprot ID: Q13769
  ENSP ID: ENSP00000380969
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQASLPVQEYLFMPFDQAHKQYETARHLPPPLYVLFVQATAYGQACDKTLSVAIEGSVDEAKALFKPPEDSQDDESDSDAEEEQTTKRRRPTLGVQLDDKRKEMLKRHPLSVMLDLKCKDDSVLHLTFYYLMNLNIMTVKAKVTTAMELITPISAGDLLSPDSVLSCLYPGDHGKKTPNPANQYQFDKVGILTLSDYVLELGHPYLWVQKLGGLHFPKEQPQQTVIADHSLSASHMETTMKLLKTRVQSRLALHKQFASLEHGIVPVTSDCQYLFPAKVVSRLVKWVTVAHEDYMELHFTKDIVDAGLAGDTNLYYMALIERGTAKLQAAVVLNPGYSSIPPVFQLCLNWKGEKTNSNDDNIRAMEGEVNVCYKELCGPWPSHQLLTNQLQRLCVLLDVYLETESHDDSVEGPKEFPQEKMCLRLFRGPSRMKPFKYNHPQGFFSHR

SEQ ID NO: 88524 - protein, 683 aa, Homo sapiens; identical to SEQ ID NO: 88523
  Payload ID: 17724
  Gene Name: THO complex 5
  Uniprot ID: Q13769
  ENSP ID: ENSP00000380970

SEQ ID NO: 88525 - protein, 683 aa, Homo sapiens; identical to SEQ ID NO: 88523
  Payload ID: 17724
  Gene Name: THO complex 5
  Uniprot ID: Q13769
  ENSP ID: ENSP00000380971

SEQ ID NO: 88526 - protein, 93 aa, Homo sapiens
  Payload ID: 17724
  Gene Name: THO complex 5
  ENSP ID: ENSP00000388039
MSSESSKKRKPKVIRSDGAPAEGKRNRSDTEQEGKYYSEEAEVDLRDPGRDYELYKYTCQELQRLMAEIQDLKSRGGKDVAIEIEERRIQSCV

SEQ ID NO: 88527 - protein, 262 aa, Homo sapiens
  Payload ID: 17724
  Gene Name: THO complex 5
  ENSP ID: ENSP00000393247
  MOD_RES (1)..(1): Any amino acid
XKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQASLPVQEYLFMPFDQAHKQYETARHLPPPLYVLFVQATAYGQACAHMKSSQPPRQDKTLSVAIEGSVDEAKALFKPPEDSQDDESDSDAEEEQTTKRRRPTLGVQLDDKRKEMLKRHPLSVMLDLKCKDDSVLHLTFYYLMNLNIMTVKAKVTTAMELITPISA

SEQ ID NO: 88528 - protein, 43 aa, Homo sapiens
  Payload ID: 17724
  Gene Name: THO complex 5
  ENSP ID: ENSP00000393420
MSSESSKKRKPKVIRSDGAPAEGKRNRSDTEQEGKYYSEEADG

SEQ ID NO: 88529 - protein, 223 aa, Homo sapiens
  Payload ID: 17724
  Gene Name: THO complex 5
  ENSP ID: ENSP00000413505
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKK

SEQ ID NO: 88530 - protein, 176 aa, Homo sapiens
  Payload ID: 17724
  Gene Name: THO complex 5
  ENSP ID: ENSP00000415425
MILRPPQLCGTEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQ

SEQ ID NO: 88531 - protein, 343 aa, Homo sapiens
  Payload ID: 17724
  Gene Name: THO complex 5
  ENSP ID: ENSP00000416500
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQASLPVQEYLFMPFDQAHKQYETARHLPPPLYVLFVQATAYGQACAHMKSSQPPRQDKTLSVAIEGSVDEAKALFKPPEDSQDDESDSDAEEEQTTVPSSLEAEEV

SEQ ID NO: 88532 - protein, 161 aa, Homo sapiens
  Payload ID: 17724
  Gene Name: THO complex 5
  ENSP ID: ENSP00000416804
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVS

SEQ ID NO: 88533 - protein, 683 aa, Homo sapiens; identical to SEQ ID NO: 88523
  Payload ID: 17724
  Gene Name: THO complex 5
  Uniprot ID: Q13769
  ENSP ID: ENSP00000420306

SEQ ID NO: 88534 - protein, 127 aa, Homo sapiens
  Payload ID: 17724
  Gene Name: THO complex 5
  ENSP ID: ENSP00000444493
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEVVVKRLSRK

SEQ ID NO: 88535 - protein, 296 aa, Homo sapiens
  Payload ID: 17725
  Gene Name: THO complex 6
  Uniprot ID: Q86W42
  ENSP ID: ENSP00000253952
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLVLTAAGNSCRVDVFTNLGYRAFSLSF

SEQ ID NO: 88536 - protein, 341 aa, Homo sapiens
  Payload ID: 17725
  Gene Name: THO complex 6
  Uniprot ID: Q86W42
  ENSP ID: ENSP00000326531
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 88537 - protein, 317 aa, Homo sapiens
  Payload ID: 17725
  Gene Name: THO complex 6
  Uniprot ID: Q86W42
  ENSP ID: ENSP00000458295
MTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 88538 - protein, 317 aa, Homo sapiens; identical to SEQ ID NO: 88537
  Payload ID: 17725
  Gene Name: THO complex 6
  Uniprot ID: Q86W42
  ENSP ID: ENSP00000460015

SEQ ID NO: 88539 - protein, 204 aa, Homo sapiens
  Payload ID: 17726
  Gene Name: THO complex 7
  Uniprot ID: Q6I9Y2
  ENSP ID: ENSP00000295899
MGAVTDDEVIRKRLLIDGDGAGDDRRINLLVKSFIKWCNSGSQEEGYSQYQRMLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 88540 - protein, 152 aa, Homo sapiens
  Payload ID: 17726
  Gene Name: THO complex 7
  ENSP ID: ENSP00000418518
MLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 88541 - protein, 60 aa, Homo sapiens
  Payload ID: 17726
  Gene Name: THO complex 7
  ENSP ID: ENSP00000419443
MLSTLSQCEFSMGKTLLVYDMNLREMENYEKIYKEIECSIAGAHEKIAECKKQILQAKRI

SEQ ID NO: 88542 - protein, 30 aa, Homo sapiens
  Payload ID: 17726
  Gene Name: THO complex 7
  ENSP ID: ENSP00000419682
  MOD_RES (1)..(1): Any amino acid
XEVIRKRLLIDGDGAGDDRRINLLVKSFIK

SEQ ID NO: 88543 - protein, 175 aa, Homo sapiens
  Payload ID: 17727
  Gene Name: three prime repair exonuclease 1
  ENSP ID: ENSP00000411331
MLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 88544 - protein, 175 aa, Homo sapiens; identical to SEQ ID NO: 88543
  Payload ID: 17727
  Gene Name: three prime repair exonuclease 1
  ENSP ID: ENSP00000412404

SEQ ID NO: 88545 - protein, 304 aa, Homo sapiens
  Payload ID: 17727
  Gene Name: three prime repair exonuclease 1
  Uniprot ID: Q9NSU2
  ENSP ID: ENSP00000415972
MQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 88546 - protein, 314 aa, Homo sapiens; identical to SEQ ID NO: 7857
  Payload ID: 17727
  Gene Name: three prime repair exonuclease 1
  Uniprot ID: Q9NSU2
  ENSP ID: ENSP00000486444

SEQ ID NO: 88547 - protein, 369 aa, Homo sapiens
  Payload ID: 17727
  Gene Name: three prime repair exonuclease 1
  Uniprot ID: Q9NSU2
  ENSP ID: ENSP00000486676
MGPGARRQGRIVQGRPEMCFCPPPTPLPPLRILTLGTHTPTPCSSPGSAAGTYPTMGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 88548 - protein, 236 aa, Homo sapiens
  Payload ID: 17728
  Gene Name: three prime repair exonuclease 2
  Uniprot ID: Q9BQ50
  ENSP ID: ENSP00000333441
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 88549 - protein, 279 aa, Homo sapiens
  Payload ID: 17728
  Gene Name: three prime repair exonuclease 2
  Uniprot ID: Q9BQ50
  ENSP ID: ENSP00000334993
MGRAGSPLPRSSWPRMDDCGSRSRCSPTLCSSLRTCYPRGNITMSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 88550 - protein, 236 aa, Homo sapiens; identical to SEQ ID NO: 88548
  Payload ID: 17728
  Gene Name: three prime repair exonuclease 2
  Uniprot ID: Q9BQ50
  ENSP ID: ENSP00000345218

SEQ ID NO: 88551 - protein, 279 aa, Homo sapiens; identical to SEQ ID NO: 88549
  Payload ID: 17728
  Gene Name: three prime repair exonuclease 2
  Uniprot ID: Q9BQ50
  ENSP ID: ENSP00000359231

SEQ ID NO: 88552 - protein, 236 aa, Homo sapiens; identical to SEQ ID NO: 88548
  Payload ID: 17728
  Gene Name: three prime repair exonuclease 2
  Uniprot ID: Q9BQ50
  ENSP ID: ENSP00000359251

SEQ ID NO: 88553 - protein, 279 aa, Homo sapiens; identical to SEQ ID NO: 88549
  Payload ID: 17728
  Gene Name: three prime repair exonuclease 2
  Uniprot ID: Q9BQ50
  ENSP ID: ENSP00000359252

SEQ ID NO: 88554 - protein, 236 aa, Homo sapiens; identical to SEQ ID NO: 88548
  Payload ID: 17728
  Gene Name: three prime repair exonuclease 2
  Uniprot ID: Q9BQ50
  ENSP ID: ENSP00000377442

SEQ ID NO: 88555 - protein, 743 aa, Homo sapiens
  Payload ID: 17729
  Gene Name: threonine synthase-like 1
  Uniprot ID: Q8IYQ7
  ENSP ID: ENSP00000365534
MLHFNRCHHLKKITQKCFSSIHVKTDKHAQRFLSRTFALAELRKSWYSTHSLVGDKNIILMGPPGAGKTTVGRIIGQKLGCCVIDVDDDILEKTWNMSVSEKLQDVGNEQFLEEEGKAVLNFSASGSVISLTGSNPMHDASMWHLKKNGIIVYLDVPLLDLICRLKLMKTDRIVGQNSGTSMKDLLKFRRQYYKKWYDARVFCESGASPEEVADKVLNAIKRYQDVDSETFISTRHVWPEDCEQKVSAKFFSEAVIEGLASDGGLFVPAKEFPKLSCGEWKSLVGATYVERAQILLERCIHPADIPAARLGEMIETAYGENFACSKIAPVRHLSGNQFILELFHGPTGSFKDLSLQLMPHIFAHCIPPSCNYMILVATSGDTGSAVLNGFSRLNKNDKQRIAVVAFFPENGVSDFQKAQIIGSQRENGWAVGVESDFDFCQTAIKRIFNDSDFTGFLTVEYGTILSSANSINWGRLLPQVVYHASAYLDLVSQGFISFGSPVDVCIPTGNFGNILAAVYAKMMGIPIRKFICASNQNHVLTDFIKTGHYDLRERKLAQTFSPSIDILKSSNLERHLHLMANKDGQLMTELFNRLESQHHFQIEKALVEKLQQDFVADWCSEGECLAAINSTYNTSGYILDPHTAVAKVVADRVQDKTCPVIISSTAHYSKFAPAIMQALKIKEINETSSSQLYLLGSYNALPPLHEALLERTKQQEKMEYQVCAADMNVLKSHVEQLVQNQFI

SEQ ID NO: 88556 - protein, 743 aa, Homo sapiens; identical to SEQ ID NO: 88555
  Payload ID: 17729
  Gene Name: threonine synthase-like 1
  Uniprot ID: Q8IYQ7
  ENSP ID: ENSP00000434887

SEQ ID NO: 88557 - protein, 484 aa, Homo sapiens
  Payload ID: 17730
  Gene Name: threonine synthase-like 2
  Uniprot ID: Q86YJ6
  ENSP ID: ENSP00000327323
MWYVSTRGVAPRVNFEGALFSGYAPDGGLFMPEELPQLDRGTLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKLSEAVTSVSVSDEAITQTMGRCWDENQYLLCPHSAVAVNYHYQQIDRQQPSTPRCCLAPASAAKFPEAVLAAGLTPETPAEIVALEHKETRCTLMRRGDNWMLMLRDTIEDLSRQWRSHALNTSQ

SEQ ID NO: 88558 - protein, 405 aa, Homo sapiens
  Payload ID: 17730
  Gene Name: threonine synthase-like 2
  Uniprot ID: Q86YJ6
  ENSP ID: ENSP00000339563
MWYVSTRGVAPRVNFEGALFSGYAPDGGLFMPEELPQLDRGTLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKWERQDYEKMAVMECDGCCVELCLGNCGPRRGSVTDIPGTAMVRGGG

SEQ ID NO: 88559 - protein, 226 aa, Homo sapiens
  Payload ID: 17730
  Gene Name: threonine synthase-like 2
  ENSP ID: ENSP00000366464
MDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKHSPVLPRPCLCSQVPGSCPGCWPDP

SEQ ID NO: 88560 - protein, 126 aa, Homo sapiens
  Payload ID: 17730
  Gene Name: threonine synthase-like 2
  ENSP ID: ENSP00000391300
MWYVSTRGVAPRVNFEGALFSGYAPDGGLFMPEELPQLDRGTLCQWSTLSYPGLVKELCALFIGSELLPKDELNDLIDRAFSRFRHREVVHLSRLRNGLNVLELWHGVTYAFKDLSLSCTTQFLQY

SEQ ID NO: 88561 - protein, 258 aa, Homo sapiens
  Payload ID: 17730
  Gene Name: threonine synthase-like 2
  ENSP ID: ENSP00000407553
MELPQLDRGTLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAALPGAASPLPLQPSSRKLSWLLA

SEQ ID NO: 88562 - protein, 723 aa, Homo sapiens
  Payload ID: 17731
  Gene Name: threonyl-tRNA synthetase
  Uniprot ID: P26639
  ENSP ID: ENSP00000265112
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 88563 - protein, 756 aa, Homo sapiens
  Payload ID: 17731
  Gene Name: threonyl-tRNA synthetase
  Uniprot ID: P26639
  ENSP ID: ENSP00000387710
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISHTASCKNLSSLASLLASVAIPSSGMPWPPLFFLQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 88564 - protein, 131 aa, Homo sapiens
  Payload ID: 17731
  Gene Name: threonyl-tRNA synthetase
  ENSP ID: ENSP00000420893
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISHGKSLWWMFMLRSANRKWILL

SEQ ID NO: 88565 - protein, 129 aa, Homo sapiens
  Payload ID: 17731
  Gene Name: threonyl-tRNA synthetase
  ENSP ID: ENSP00000422130
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDL

SEQ ID NO: 88566 - protein, 118 aa, Homo sapiens
  Payload ID: 17731
  Gene Name: threonyl-tRNA synthetase
  ENSP ID: ENSP00000422291
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGIRPGRQHRYC

SEQ ID NO: 88567 - protein, 50 aa, Homo sapiens
  Payload ID: 17731
  Gene Name: threonyl-tRNA synthetase
  ENSP ID: ENSP00000422598
MYNILKAEHDSILAEKAEKDSKPIKVTLPDGKQVDAESWKTTPYQIACGI

SEQ ID NO: 88568 - protein, 723 aa, Homo sapiens; identical to SEQ ID NO: 88562
  Payload ID: 17731
  Gene Name: threonyl-tRNA synthetase
  Uniprot ID: P26639
  ENSP ID: ENSP00000424387

SEQ ID NO: 88569 - protein, 66 aa, Homo sapiens
  Payload ID: 17731
  Gene Name: threonyl-tRNA synthetase
  ENSP ID: ENSP00000425524
MFEEKASSPSGKMGGEEKPIGAGEEKQKEGGKKKNKEGSGDGGRAEGNLQVLFISAITETDTEGIC

SEQ ID NO: 88570 - protein, 55 aa, Homo sapiens
  Payload ID: 17731
  Gene Name: threonyl-tRNA synthetase
  ENSP ID: ENSP00000427304
MFEEKASSPSGKMGGEEKPIGAGEEKQKEGGKKKNKEGSGDGGRAERLTQRVSAE

SEQ ID NO: 88571 - protein, 56 aa, Homo sapiens
  Payload ID: 17731
  Gene Name: threonyl-tRNA synthetase
  ENSP ID: ENSP00000427627
MFEEKASSPSGKMGGEEKPIGAGEEKQKEGGKKKNKEGSGDGGRAESRPGRQHRYC

SEQ ID NO: 88572 - protein, 56 aa, Homo sapiens; identical to SEQ ID NO: 88571
  Payload ID: 17731
  Gene Name: threonyl-tRNA synthetase
  ENSP ID: ENSP00000486068

SEQ ID NO: 88573 - protein, 66 aa, Homo sapiens; identical to SEQ ID NO: 88569
  Payload ID: 17731
  Gene Name: threonyl-tRNA synthetase
  ENSP ID: ENSP00000486893

SEQ ID NO: 88574 - protein, 135 aa, Homo sapiens
  Payload ID: 17732
  Gene Name: threonyl-tRNA synthetase 2, mitochondrial (putative)
  ENSP ID: ENSP00000358047
MALYQRWRCLRLQGLQACRLHTAVVSTPPRWLAERLGLFEELWAAQVKRLASMAQKEPRTIKISLPGGQKIDAVAWNTTPYQLARQISSTLADTAVVQVQNMAFTMISSWERRGVAHWLTFARAPTFGILDRLED

SEQ ID NO: 88575 - protein, 588 aa, Homo sapiens
  Payload ID: 17732
  Gene Name: threonyl-tRNA synthetase 2, mitochondrial (putative)
  Uniprot ID: Q9BW92
  ENSP ID: ENSP00000358050
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 88576 - protein, 718 aa, Homo sapiens
  Payload ID: 17732
  Gene Name: threonyl-tRNA synthetase 2, mitochondrial (putative)
  Uniprot ID: Q9BW92
  ENSP ID: ENSP00000358060
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 88577 - protein, 443 aa, Homo sapiens [sequence omitted]

SEQ ID NO: 88578 - protein, 143 aa, Homo sapiens
  Payload ID: 17732
  Gene Name: threonyl-tRNA synthetase 2, mitochondrial (putative)
  ENSP ID: ENSP00000475551
TPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKADNPGLRAACFGADLPGTYSCCSTLPEARGFTGSASPVVQG

SEQ ID NO: 88579 - protein, 636 aa, Homo sapiens
  Payload ID: 17732
  Gene Name: threonyl-tRNA synthetase 2, mitochondrial (putative)
  ENSP ID: ENSP00000475847
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 88580 - protein, 802 aa, Homo sapiens
  Payload ID: 17733
  Gene Name: threonyl-tRNA synthetase-like 2
  Uniprot ID: A2RTX5
  ENSP ID: ENSP00000338093
MAAEALAAEAVASRLERQEEDIRWLWSEVERLRDEQLNAPYSCQAEGPCLTREVAQLRAENCDLRHRLCSLRLCLAEERSRQATLESAELEAAQEAGAQPPPSQSQDKDMKKKKMKESEADSEVKHQPIFIKERLKLFEILKKDHQLLLAIYGKKGDTSNIITVRVADGQTVQGEVWKTTPYQVAAEISQELAESTVIAKVNGELWDLDRPLEGDSSLELLTFDNEEAQAVYWHSSAHILGEAMELYYGGHLCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIREEYHKRDFTEVLSPNMYNSKLWEASGHWQHYSENMFTFEIEKDTFALKPMNCPGHCLMFAHRPRSWREMPIRFADFGVLHRNELSGTLSGLTRVRRFQQDDAHIFCTVEQIEEEIKGCLQFLQSVYSTFGFSFQLNLSTRPENFLGEIEMWNEAEKQLQNSLMDFGEPWKMNPGDGAFYGPKIDIKIKDAIGRYHQCATIQLDFQLPIRFNLTYVSKDGDDKKRPVIIHRAILGSVERMIAILSENYGGKWPFWLSPRQVMVIPVGPTCEKYALQVSSEFFEEGFMADVDLDHSCTLNKKIRNAQLAQYNFILVVGEKEKIDNAVNVRTRDNKIHGEILVTSAIDKLKNLRKTRTLNAEEAF

SEQ ID NO: 88581 - protein, 766 aa, Homo sapiens
  Payload ID: 17733
  Gene Name: threonyl-tRNA synthetase-like 2
  ENSP ID: ENSP00000439899
MAAEALAAEAVASRLERQEEDIRWLWSEVERLRDEQLNAPYSCQAEGPCLTREVAQLRAENCDLRHRLCSLRLCLAEERSRQATLESAELEAAQEAGAQPPPSQSQDKDMKKKKMKESEADSEVKHQPIFIKERLKLFEILKKDHQLLLAIYGKKGDTSNIITVRVADGQTVQGEVWKTTPYQVAAEISQELAESTVIAKVNGELWDLDRPLEGDSSLELLTFDNEEAQAVYWHSSAHILGEAMELYYGGHLCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIREEYHKRDFTEVLSPNMYNSKLWEASGHWQHYSENMFTFEIEKDTFALKPMNCPGHCLMFAHRPRSWREMPIRFADFGVLHRNELSGTLSGLTRVRRFQQDDAHIFCTVEQIEEEIKGCLQFLQSVYSTFGFSFQLNLSTRPENFLGEIEMWNEAEKQLQNSLMDFGEPWKMNPGDGAFYGPKIDIKIKDAIGRYHQCATIQLDFQLPIRFNLTYVSKDGDDKKRPVIIHRAILGSVERMIAILSENYGGKWPFWLSPRQVMVIPVGPTCEKYALQVSSEFFEEGFMADVDLDHSCTLNKKIRNAQLAQYNFILDRFLPSVWQEAWL

SEQ ID NO: 88582 - protein, 148 aa, Homo sapiens
  Payload ID: 17733
  Gene Name: threonyl-tRNA synthetase-like 2
  ENSP ID: ENSP00000452740
EVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIRMQDRCG

SEQ ID NO: 88583 - protein, 766 aa, Homo sapiens; identical to SEQ ID NO: 88581
  Payload ID: 17733
  Gene Name: threonyl-tRNA synthetase-like 2
  ENSP ID: ENSP00000478827

SEQ ID NO: 88584 - protein, 575 aa, Homo sapiens
  Payload ID: 17734
  Gene Name: thrombomodulin
  Uniprot ID: P07204
  ENSP ID: ENSP00000366307
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 88585 - protein, 353 aa, Homo sapiens
  Payload ID: 17735
  Gene Name: thrombopoietin
  Uniprot ID: P40225
  ENSP ID: ENSP00000204615
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 88586 - protein, 349 aa, Homo sapiens
  Payload ID: 17735
  Gene Name: thrombopoietin
  Uniprot ID: P40225
  ENSP ID: ENSP00000410763
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 88587 - protein, 286 aa, Homo sapiens
  Payload ID: 17735
  Gene Name: thrombopoietin
  ENSP ID: ENSP00000411704
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKDFWIVGDKLHCLSQNYWLWASEVAAGIQSQDSWSAEPNLQVPGPNPRIPEQDTRTLEWNSWTLSWTLTQDPRSPGHFLRNIRHRLPATQPPAWIFSFPNPSSYWTVYALPSSTHLAHPCGPAPPPAS

SEQ ID NO: 88588 - protein, 1170 aa, Homo sapiens
  Payload ID: 17736
  Gene Name: thrombospondin 1
  Uniprot ID: P07996
  ENSP ID: ENSP00000260356
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 88589 - protein, 94 aa, Homo sapiens
  Payload ID: 17736
  Gene Name: thrombospondin 1
  ENSP ID: ENSP00000380720
MGLAWGLGVLFLMHVCGTNRIPESGGDNSVFDIFELTGAARKGSGRRLVKGPDPSSPAFRIEDANLIPPVPDDKFQDLVDAVRAEKGFLLLASL

SEQ ID NO: 88590 - protein, 1172 aa, Homo sapiens
  Payload ID: 17737
  Gene Name: thrombospondin 2
  Uniprot ID: P35442
  ENSP ID: ENSP00000355751
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 88591 - protein, 83 aa, Homo sapiens
  Payload ID: 17737
  Gene Name: thrombospondin 2
  ENSP ID: ENSP00000398928
MVWRLVLLALWVWPSTQAGHQDKDTTFDLFSISNINRKTIGAKQFRGPDPGVPAYRFVRFDYIPPVNADDLSKITKIMRQKEG

SEQ ID NO: 88592 - protein, 1172 aa, Homo sapiens; identical to SEQ ID NO: 88590
  Payload ID: 17737
  Gene Name: thrombospondin 2
  Uniprot ID: P35442
  ENSP ID: ENSP00000482784

SEQ ID NO: 88593 - protein, 956 aa, Homo sapiens
  Payload ID: 17738
  Gene Name: thrombospondin 3
  Uniprot ID: P49746
  ENSP ID: ENSP00000357362
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 88594 - protein, 836 aa, Homo sapiens
  Payload ID: 17738
  Gene Name: thrombospondin 3
  Uniprot ID: P49746
  ENSP ID: ENSP00000392207
METQELRGALALLLLCFFTSASQDLQVIDLLTVGESRQMVAVAEKIRTALLTAGDIYLLSTFRLPPKQGGVLFGLYSRQDNTRWLEASVVGKINKVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 88595 - protein, 400 aa, Homo sapiens
  Payload ID: 17738
  Gene Name: thrombospondin 3
  ENSP ID: ENSP00000404040
METQELRGALALLLLCFFTSASQDLQVIDLLTVGESRQMVAVAEKIRTALLTAGDIYLLSTFRLPPKQGGVLFGLYSRQDNTRWLEASVVGKINKVTNALHSILGEGNVPDPKHHYGVSGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEASPMDWTIALKSPTHYRQTGMRTGWEMLATAALK

SEQ ID NO: 88596 - protein, 485 aa, Homo sapiens
  Payload ID: 17738
  Gene Name: thrombospondin 3
  ENSP ID: ENSP00000437353
MDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 88597 - protein, 947 aa, Homo sapiens
  Payload ID: 17738
  Gene Name: thrombospondin 3
  ENSP ID: ENSP00000444792
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 88598 - protein, 961 aa, Homo sapiens
  Payload ID: 17739
  Gene Name: thrombospondin 4
  Uniprot ID: P35443
  ENSP ID: ENSP00000339730
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 88599 - protein, 870 aa, Homo sapiens
  Payload ID: 17739
  Gene Name: thrombospondin 4
  ENSP ID: ENSP00000422298
MGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 88600 - protein, 852 aa, Homo sapiens
  Payload ID: 17740
  Gene Name: thrombospondin, type I, domain containing 1
  Uniprot ID: Q9NS62
  ENSP ID: ENSP00000258613
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTETWGLWQPWSQCSATCGDGVRERRRVCLTSFPSSPVCPGMSLEASLCSLEECAAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 88601 - protein, 799 aa, Homo sapiens
  Payload ID: 17740
  Gene Name: thrombospondin, type I, domain containing 1
  Uniprot ID: Q9NS62
  ENSP ID: ENSP00000340650
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 88602 - protein, 219 aa, Homo sapiens
  Payload ID: 17741
  Gene Name: thrombospondin, type I, domain containing 4
  Uniprot ID: Q6ZMP0
  ENSP ID: ENSP00000261862
MFVSYLILTLLHVQTAVLARPGGESIGCDDYLGSDKVVDKCGVCGGDNTGCQVVSGVFKHALTSLGYHRVVEIPEGATKINITEMYKSNKKKSHLKPATRGSQFSSVKVCSVPAACKLLGTPGRARQPVPAPRELEHDKNSPHCAYLSLYLTSLAQSSWRVFSLFSYVLIYLFSKYLAFNTLFALKRMALQRDRKEKTRAWCIFIKLCGREIQILPGPV

SEQ ID NO: 88603 - protein, 1018 aa, Homo sapiens
  Payload ID: 17741
  Gene Name: thrombospondin, type I, domain containing 4
  Uniprot ID: Q6ZMP0
  ENSP ID: ENSP00000347484
MVSHFMGSLSVLCFLLLLGFQFVCPQPSTQHRKVPQRMAAEGAPEDDGGGGAPGVWGAWGPWSACSRSCSGGVMEQTRPCLPRSYRLRGGQRPGAPARAFADHVVSAVRTSVPLHRSRDETPALAGTDASRQGPTVLRGSRHPQPQGLEVTGDRRSRTRGTIGPGKYGYGKAPYILPLQTDTAHTPQRLRRQKLSSRHSRSQGASSARHGYSSPAHQVPQHGPLYQSDSGPRSGLQAAEAPIYQLPLTHDQGYPAASSLFHSPETSNNHGVGTHGATQSFSQPARSTAISCIGAYRQYKLCNTNVCPESSRSIREVQCASYNNKPFMGRFYEWEPFAEVKGNRKCELNCQAMGYRFYVRQAEKVIDGTPCDQNGTAICVSGQCKSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 88604 - protein, 658 aa, Homo sapiens
  Payload ID: 17741
  Gene Name: thrombospondin, type I, domain containing 4
  Uniprot ID: Q6ZMP0
  ENSP ID: ENSP00000350413
MFVSYLILTLLHVQTAVLARPGGESIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 88605 - protein, 101 aa, Homo sapiens
  Payload ID: 17741
  Gene Name: thrombospondin, type I, domain containing 4
  ENSP ID: ENSP00000484438
MVSHFMGSLSVLCFLLLLGFQFVCPQPSTQHRKVPQRMAAEGAPEDDGGGGAPGVWGAWGPWSACSRSCSGGVMEQTRPCLPRSYRLRGGQRPGAPARAFA

SEQ ID NO: 88606 - protein, 1657 aa, Homo sapiens
  Payload ID: 17742
  Gene Name: thrombospondin, type I, domain containing 7A
  Uniprot ID: Q9UPZ6
  ENSP ID: ENSP00000406482
MGLQARRWASGSRGAAGPRRGVLQLLPLPLPLPLLLLLLLRPGAGRAAAQGEAEAPTLYLWKTGPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGNCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQAQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTWVYGVAAGAFVLLIFIVSMIYLACKKPKKPQRRQNNRLKPLTLAYDGDADM

SEQ ID NO: 88607 - protein, 1657 aa, Homo sapiens
  Payload ID: 17742
  Gene Name: thrombospondin, type I, domain containing 7A
  ENSP ID: ENSP00000481440
MGLQARRWASGSRGAAGPRRGVLQLLPLPLPLPLLLLLLLRPGAGRAAAQGEAEAPTLYLWKTGPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGNCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQFQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTWVYGVAAGAFVLLIFIVSMIYLACKKPKKPQRRQNNRLKPLTLAYDGDADM

SEQ ID NO: 88608 - protein, 1608 aa, Homo sapiens
  Payload ID: 17743
  Gene Name: thrombospondin, type I, domain containing 7B
  Uniprot ID: Q9C0I4
  ENSP ID: ENSP00000272643
MFPKSNLTVTCWVWRSMRKLFLLLSLLLSHAAHLEGKKDNQFIWKPGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQGQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 88609 - protein, 1606 aa, Homo sapiens
  Payload ID: 17743
  Gene Name: thrombospondin, type I, domain containing 7B
  ENSP ID: ENSP00000387145
MFPKSNLTVTCWVWRSMRKLFLLLSLLLSHAAHLEGKKDNQFIWKPGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 88610 - protein, 1577 aa, Homo sapiens
  Payload ID: 17743
  Gene Name: thrombospondin, type I, domain containing 7B
  ENSP ID: ENSP00000413841
MHNTADEVVLYHKLAGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQAQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 88611 - protein, 50 aa, Homo sapiens
  Payload ID: 17743
  Gene Name: thrombospondin, type I, domain containing 7B
  ENSP ID: ENSP00000473349
MFPKSNLTVTCWVWRSMRKLFLLLSLLLSHAAHLEGKKDNQFIWKPGLAK

SEQ ID NO: 88612 - protein, 669 aa, Homo sapiens
  Payload ID: 17744
  Gene Name: thrombospondin-type laminin G domain and EAR repeats
  Uniprot ID: Q8WU66
  ENSP ID: ENSP00000321987
MSALLSLCFVLPLAAPGHGTQGWEPCTDLRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 88613 - protein, 530 aa, Homo sapiens
  Payload ID: 17744
  Gene Name: thrombospondin-type laminin G domain and EAR repeats
  ENSP ID: ENSP00000381012
MSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSGGRRGLHARRAEG

SEQ ID NO: 88614 - protein, 522 aa, Homo sapiens
  Payload ID: 17744
  Gene Name: thrombospondin-type laminin G domain and EAR repeats
  ENSP ID: ENSP00000478010
MSALLSLCFVLPLAAPGHGTQGWEPCTDLRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 88615 - protein, 601 aa, Homo sapiens
  Payload ID: 17744
  Gene Name: thrombospondin-type laminin G domain and EAR repeats
  ENSP ID: ENSP00000482422
MSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 88616 - protein, 534 aa, Homo sapiens
  Payload ID: 17745
  Gene Name: thromboxane A synthase 1 (platelet)
  ENSP ID: ENSP00000263552
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 88617 - protein, 533 aa, Homo sapiens
  Payload ID: 17745
  Gene Name: thromboxane A synthase 1 (platelet)
  Uniprot ID: P24557
  ENSP ID: ENSP00000338087
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 88618 - protein, 150 aa, Homo sapiens
  Payload ID: 17745
  Gene Name: thromboxane A synthase 1 (platelet)
  ENSP ID: ENSP00000388612
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNE

SEQ ID NO: 88619 - protein, 466 aa, Homo sapiens
  Payload ID: 17745
  Gene Name: thromboxane A synthase 1 (platelet)
  Uniprot ID: P24557
  ENSP ID: ENSP00000388736
MELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 88620 - protein, 580 aa, Homo sapiens
  Payload ID: 17745
  Gene Name: thromboxane A synthase 1 (platelet)
  ENSP ID: ENSP00000389414
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNELGLLIMQERIKGHMGGQQAPQRIPPTRLSKPSGIYVNLHYATLPFCMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 88621 - protein, 151 aa, Homo sapiens
  Payload ID: 17745
  Gene Name: thromboxane A synthase 1 (platelet)
  ENSP ID: ENSP00000391567
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMPQSIMPNSRHHVASRGMWPGGRRLACYLHPFRMAEGIAEV

SEQ ID NO: 88622 - protein, 460 aa, Homo sapiens
  Payload ID: 17745
  Gene Name: thromboxane A synthase 1 (platelet)
  ENSP ID: ENSP00000392702
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERYRCS

SEQ ID NO: 88623 - protein, 533 aa, Homo sapiens; identical to SEQ ID NO: 88617
  Payload ID: 17745
  Gene Name: thromboxane A synthase 1 (platelet)
  Uniprot ID: P24557
  ENSP ID: ENSP00000402536

SEQ ID NO: 88624 - protein, 579 aa, Homo sapiens
  Payload ID: 17745
  Gene Name: thromboxane A synthase 1 (platelet)
  Uniprot ID: P24557
  ENSP ID: ENSP00000411274
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNELGLLIMQERIKGHMGGQQAPQRIPPTRLSKPSGIYVNLHYATLPFCMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 88625 - protein, 459 aa, Homo sapiens
  Payload ID: 17745
  Gene Name: thromboxane A synthase 1 (platelet)
  Uniprot ID: P24557
  ENSP ID: ENSP00000411326
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERYRCS

SEQ ID NO: 88626 - protein, 80 aa, Homo sapiens
  Payload ID: 17745
  Gene Name: thromboxane A synthase 1 (platelet)
  ENSP ID: ENSP00000412710
MEALGFLKLEVNGPMVTVALSVALLALLKWYSTSAFSRLEKLGLRHPKPSPFIGNLTFFRQGFWESQMELRKLYGPLCGL

SEQ ID NO: 88627 - protein, 79 aa, Homo sapiens
  Payload ID: 17745
  Gene Name: thromboxane A synthase 1 (platelet)
  ENSP ID: ENSP00000415892
MEALGFLKLEVNGPMVTVALSVALLALLKWYSTSAFSRLEKLGLRHPKPSPFIGNLTFFRQGFWESQMELRKLYGPLCG

SEQ ID NO: 88628 - protein, 343 aa, Homo sapiens
  Payload ID: 17746
  Gene Name: thromboxane A2 receptor
  Uniprot ID: P21731
  ENSP ID: ENSP00000364336
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRSLSLQPQLTQRSGLQ

SEQ ID NO: 88629 - protein, 407 aa, Homo sapiens
  Payload ID: 17746
  Gene Name: thromboxane A2 receptor
  Uniprot ID: P21731
  ENSP ID: ENSP00000393333
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRRSLTLWPSLEYSGTISAHCNLRLPGSSDSRASASRAAGITGVSHCARPCMLFDPEFDLLAGVQLLPFEPPTGKALSRKD

SEQ ID NO: 88630 - protein, 259 aa, Homo sapiens
  Payload ID: 17746
  Gene Name: thromboxane A2 receptor
  ENSP ID: ENSP00000468145
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGLHRPDSAAKPACHEPRRAAVPHHGEGAAHLLARGHLEPDPGPLGVYPVPPRRAPASPASPQHPAQVAVPPAPAHAALRAAVGSGQSAPPAPFRGALGPSDSPSACSEDSGAGGAGWTVGISSRVLG

SEQ ID NO: 88631 - protein, 353 aa, Homo sapiens
  Payload ID: 17747
  Gene Name: THUMP domain containing 1
  Uniprot ID: Q9NXG2
  ENSP ID: ENSP00000370741
MAAPAQQTTQPGGGKRKGKAQYVLAKRARRCDAGGPRQLEPGLQGILITCNMNERKCVEEAYSLLNEYGDDMYGPEKFTDKDQQPSGSEGEDDDAEAALKKEVGDIKASTEMRLRRFQSVESGANNVVFIRTLGIEPEKLVHHILQDMYKTKKKKTRVILRMLPISGTCKAFLEDMKKYAETFLEPWFKAPNKGTFQIVYKSRNNSHVNREEVIRELAGIVCTLNSENKVDLTNPQYTVVVEIIKAVCCLSVVKDYMLFRKYNLQEVVKSPKDPSQLNSKQGNGKEAKLESADKSDQNNTAEGKNNQQVPENTEELGQTKPTSNPQVVNEGGAKPELASQATEGSKSNENDFS

SEQ ID NO: 88632 - protein, 353 aa, Homo sapiens; identical to SEQ ID NO: 88631
  Payload ID: 17747
  Gene Name: THUMP domain containing 1
  Uniprot ID: Q9NXG2
  ENSP ID: ENSP00000379392

SEQ ID NO: 88633 - protein, 145 aa, Homo sapiens
  Payload ID: 17747
  Gene Name: THUMP domain containing 1
  ENSP ID: ENSP00000455033
MAAPAQQTTQPGGGKRKGKAQYVLAKRARRCDAGGPRQLEPGLQGILITCNMNERKCVEEAYSLLNEYGDDMYGPEKFTDKDQQPSGSEGEDDDAEAALKKEVGDIKASTEMRLRRFQSVESGANNVVFIRTLGIGKQQHGVTVG

SEQ ID NO: 88634 - protein, 303 aa, Homo sapiens
  Payload ID: 17748
  Gene Name: THUMP domain containing 2
  Uniprot ID: Q9BTF0
  ENSP ID: ENSP00000368001
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKVPYGSD

SEQ ID NO: 88635 - protein, 503 aa, Homo sapiens
  Payload ID: 17748
  Gene Name: THUMP domain containing 2
  Uniprot ID: Q9BTF0
  ENSP ID: ENSP00000423933
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 88636 - protein, 291 aa, Homo sapiens
  Payload ID: 17748
  Gene Name: THUMP domain containing 2
  ENSP ID: ENSP00000426202
VMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQVLYMGLSPGPRLQMHMRSQQCREERTPQTVAITRPHQLALTKFSDVKGHWSEYFINLKISQTLKGGRKSNWNCYYETLWMESRLEESTIRDLYTSK

SEQ ID NO: 88637 - protein, 88 aa, Homo sapiens
  Payload ID: 17748
  Gene Name: THUMP domain containing 2
  ENSP ID: ENSP00000434844
EPGSGPEAGARFFCTAGRGLEPFVMREVRARLAATQVEYISGKVFFTTCSDLNMLKKLKSAERLFLLIKKQFPLIISSEKYLMKCKDL

SEQ ID NO: 88638 - protein, 507 aa, Homo sapiens
  Payload ID: 17749
  Gene Name: THUMP domain containing 3
  Uniprot ID: Q9BV44
  ENSP ID: ENSP00000339532
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEGKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGERGTLWQCKE

SEQ ID NO: 88639 - protein, 507 aa, Homo sapiens; identical to SEQ ID NO: 88638
  Payload ID: 17749
  Gene Name: THUMP domain containing 3
  Uniprot ID: Q9BV44
  ENSP ID: ENSP00000395893

SEQ ID NO: 88640 - protein, 232 aa, Homo sapiens
  Payload ID: 17749
  Gene Name: THUMP domain containing 3
  ENSP ID: ENSP00000396359
  MOD_RES (1)..(1): Any amino acid
XKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEG

SEQ ID NO: 88641 - protein, 40 aa, Homo sapiens
  Payload ID: 17749
  Gene Name: THUMP domain containing 3
  ENSP ID: ENSP00000402968
MCDIEEATNQLLDVNLHENQKSVQVTESDLGSESELLVTI

SEQ ID NO: 88642 - protein, 123 aa, Homo sapiens
  Payload ID: 17749
  Gene Name: THUMP domain containing 3
  ENSP ID: ENSP00000411126
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGK

SEQ ID NO: 88643 - protein, 269 aa, Homo sapiens
  Payload ID: 17749
  Gene Name: THUMP domain containing 3
  ENSP ID: ENSP00000412199
  MOD_RES (1)..(1): Any amino acid
XRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLSKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGE

SEQ ID NO: 88644 - protein, 507 aa, Homo sapiens; identical to SEQ ID NO: 88638
  Payload ID: 17749
  Gene Name: THUMP domain containing 3
  Uniprot ID: Q9BV44
  ENSP ID: ENSP00000424064

SEQ ID NO: 88645 - protein, 161 aa, Homo sapiens
  Payload ID: 17750
  Gene Name: Thy-1 cell surface antigen
  Uniprot ID: P04216
  ENSP ID: ENSP00000284240
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 88646 - protein, 161 aa, Homo sapiens; identical to SEQ ID NO: 88645
  Payload ID: 17750
  Gene Name: Thy-1 cell surface antigen
  Uniprot ID: P04216
  ENSP ID: ENSP00000431301

SEQ ID NO: 88647 - protein, 37 aa, Homo sapiens
  Payload ID: 17750
  Gene Name: Thy-1 cell surface antigen
  ENSP ID: ENSP00000432051
MNLAISIALLLTGLPRAEGDQPNGLPSGPEPSSGLPP

SEQ ID NO: 88648 - protein, 165 aa, Homo sapiens
  Payload ID: 17750
  Gene Name: Thy-1 cell surface antigen
  ENSP ID: ENSP00000432808
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRGHGFHVPVTGGAHGGDRKPQVPVQRSYFSESADPLPPIPQT

SEQ ID NO: 88649 - protein, 152 aa, Homo sapiens
  Payload ID: 17750
  Gene Name: Thy-1 cell surface antigen
  ENSP ID: ENSP00000435753
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSL

SEQ ID NO: 88650 - protein, 144 aa, Homo sapiens
  Payload ID: 17750
  Gene Name: Thy-1 cell surface antigen
  ENSP ID: ENSP00000464248
MNLAISIALLLTVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 88651 - protein, 159 aa, Homo sapiens
  Payload ID: 17751
  Gene Name: thymic stromal lymphopoietin
  Uniprot ID: Q969D9
  ENSP ID: ENSP00000339804
MFPFALLYVLSVSFRKIFILQLVGLVLTYDFTNCDFEKIKAAYLSTISKDLITYMSGTKSTEFNNTVSCSNRPHCLTEIQSLTFNPTAGCASLAKEMFAMKTKAALAIWCPGYSETQINATQAMKKRRKRKVTTNKCLEQVSQLQGLWRRFNRPLLKQQ

SEQ ID NO: 88652 - protein, 159 aa, Homo sapiens
  Payload ID: 17751
  Gene Name: thymic stromal lymphopoietin
  ENSP ID: ENSP00000399099
MKCLGQSKKEEVSFRKIFILQLVGLVLTYDFTNCDFEKIKAAYLSTISKDLITYMSGTKSTEFNNTVSCSNRPHCLTEIQSLTFNPTAGCASLAKEMFAMKTKAALAIWCPGYSETQINATQAMKKRRKRKVTTNKCLEQVSQLQGLWRRFNRPLLKQQ

SEQ ID NO: 88653 - protein, 63 aa, Homo sapiens
  Payload ID: 17751
  Gene Name: thymic stromal lymphopoietin
  Uniprot ID: Q969D9
  ENSP ID: ENSP00000427827
MFAMKTKAALAIWCPGYSETQINATQAMKKRRKRKVTTNKCLEQVSQLQGLWRRFNRPLLKQQ

SEQ ID NO: 88654 - protein, 234 aa, Homo sapiens
  Payload ID: 17752
  Gene Name: thymidine kinase 1, soluble
  Uniprot ID: P04183
  ENSP ID: ENSP00000301634
MSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVEVIGGADKYHSVCRLCYFKKASGQPAGPDNKENCPVPGKPGEAVAARKLFAPQQILQCSPAN

SEQ ID NO: 88655 - protein, 87 aa, Homo sapiens
  Payload ID: 17752
  Gene Name: thymidine kinase 1, soluble
  ENSP ID: ENSP00000467121
MSCINLPTVLPGSPSKTRGQIQVILGPMFSGKSTELMRRVRRFQIAQYKCLVIKYAKDTRYSSSFCTHDRSLTSWSSARPWPTPGRP

SEQ ID NO: 88656 - protein, 187 aa, Homo sapiens
  Payload ID: 17752
  Gene Name: thymidine kinase 1, soluble
  ENSP ID: ENSP00000468278
MSCINLPTVLPGSPSKTRGQIQVILGPMFSGKSTELMRRVRRFQIAQYKCLVIKYAKDTRYSSSFCTHDRTRSRIIARNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVEVIGGAD

SEQ ID NO: 88657 - protein, 267 aa, Homo sapiens
  Payload ID: 17752
  Gene Name: thymidine kinase 1, soluble
  ENSP ID: ENSP00000468425
MSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVAPPAFPAGRRGGGMALPPSCPGPSPIPCPCGQVEVIGGADKYHSVCRLCYFKKASGQPAGPDNKENCPVPGKPGEAVAARKLFAPQQILQCSPAN

SEQ ID NO: 88658 - protein, 180 aa, Homo sapiens
  Payload ID: 17752
  Gene Name: thymidine kinase 1, soluble
  ENSP ID: ENSP00000468556
MSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEQILQCSPAN

SEQ ID NO: 88659 - protein, 265 aa, Homo sapiens
  Payload ID: 17753
  Gene Name: thymidine kinase 2, mitochondrial
  Uniprot ID: O00142
  ENSP ID: ENSP00000299697
MLLWPLRGWAARALRCFGPGSRGSPASGPGPRRVQRRAWPPDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 88660 - protein, 289 aa, Homo sapiens
  Payload ID: 17753
  Gene Name: thymidine kinase 2, mitochondrial
  ENSP ID: ENSP00000407469
MRPGLFKGQAPGSRRRPTAGLAVVRADSHKKEPRASGSARPAMLLWPLRGWAARALRCFGPGSRGSPASGPGPRRVQRRAWPPDKEQEKEKKSVICVEGNIASGKTTCLEFFSNATDVEGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 88661 - protein, 307 aa, Homo sapiens
  Payload ID: 17753
  Gene Name: thymidine kinase 2, mitochondrial
  ENSP ID: ENSP00000414334
MRPGLFKGQAPGSRRRPTAGLAVVRADSHKKEPRASGSARPAMLLWPLRGWAARALRCFGPGSRGSPASGPGPRRVQRRAWPPDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 88662 - protein, 168 aa, Homo sapiens
  Payload ID: 17753
  Gene Name: thymidine kinase 2, mitochondrial
  Uniprot ID: O00142
  ENSP ID: ENSP00000433770
MYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 88663 - protein, 168 aa, Homo sapiens; identical to SEQ ID NO: 88662
  Payload ID: 17753
  Gene Name: thymidine kinase 2, mitochondrial
  Uniprot ID: O00142
  ENSP ID: ENSP00000434594

SEQ ID NO: 88664 - protein, 234 aa, Homo sapiens
  Payload ID: 17753
  Gene Name: thymidine kinase 2, mitochondrial
  Uniprot ID: O00142
  ENSP ID: ENSP00000435312
MGAFCQRPSSDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 88665 - protein, 240 aa, Homo sapiens
  Payload ID: 17753
  Gene Name: thymidine kinase 2, mitochondrial
  Uniprot ID: O00142
  ENSP ID: ENSP00000438143
MLLWPLRGWAARALRCFGPGSRGSPASGPGPRRVQRRAWPPDKEQEKEKKSVVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 88666 - protein, 265 aa, Homo sapiens; identical to SEQ ID NO: 88659
  Payload ID: 17753
  Gene Name: thymidine kinase 2, mitochondrial
  Uniprot ID: O00142
  ENSP ID: ENSP00000440898

SEQ ID NO: 88667 - protein, 282 aa, Homo sapiens
  Payload ID: 17753
  Gene Name: thymidine kinase 2, mitochondrial
  ENSP ID: ENSP00000455187
MLLWPLRGWAARALRCFGPGSRGSPASGPGPRRVQRRAWPPDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLVGSALSTPDRLLVFPWQEYLEAIHHLHEEWLIKGSLFPMAAPVLVIEADHHMERMLELFEQNRDRILTPENRKHCP

SEQ ID NO: 88668 - protein, 120 aa, Homo sapiens
  Payload ID: 17753
  Gene Name: thymidine kinase 2, mitochondrial
  ENSP ID: ENSP00000457959
MRPGLFKGQAPGSRRRPTAGLAVVRADSHKKEPRASGSARPAMLLWPLRGWAARALRCFGPGSRGSPASGPGPRRVQRRAWPPDKEQEKEKKSVRRRLAVLPRLASNSWAQVILWHQPPE

SEQ ID NO: 88669 - protein, 130 aa, Homo sapiens
  Payload ID: 17753
  Gene Name: thymidine kinase 2, mitochondrial
  ENSP ID: ENSP00000462341
MYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFP

SEQ ID NO: 88670 - protein, 22 aa, Homo sapiens
  Payload ID: 17753
  Gene Name: thymidine kinase 2, mitochondrial
  ENSP ID: ENSP00000462721
  MOD_RES (1)..(1): Any amino acid
XEEWLIKGSLFPMAAPVLEPFT

SEQ ID NO: 88671 - protein, 88 aa, Homo sapiens
  Payload ID: 17753
  Gene Name: thymidine kinase 2, mitochondrial
  ENSP ID: ENSP00000463326
MYHDASRWGLTLQTYVQLTMLDRHTRPQVSSVRLMERSIHSARYIFVENLYRSGKMPEVDYVVLSEWFDWILRNMDVSVDLIVYLRTN

SEQ ID NO: 88672 - protein, 168 aa, Homo sapiens; identical to SEQ ID NO: 88662
  Payload ID: 17753
  Gene Name: thymidine kinase 2, mitochondrial
  Uniprot ID: O00142
  ENSP ID: ENSP00000463560

SEQ ID NO: 88673 - protein, 142 aa, Homo sapiens
  Payload ID: 17753
  Gene Name: thymidine kinase 2, mitochondrial
  ENSP ID: ENSP00000464313
  MOD_RES (1)..(1): Any amino acid
XQRPSSDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRRNTWKQFTISMRSGSSKAAFSPWQPLFW

SEQ ID NO: 88674 - protein, 247 aa, Homo sapiens
  Payload ID: 17753
  Gene Name: thymidine kinase 2, mitochondrial
  Uniprot ID: O00142
  ENSP ID: ENSP00000483833
MLLWPLRGWAARALRCFGPGSRGSPASGPGPRRVQRRAWPPDKEQEKEKKSVICVEGNIASGKTTCLEFFSNATDVEGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 88675 - protein, 482 aa, Homo sapiens
  Payload ID: 17754
  Gene Name: thymidine phosphorylase
  Uniprot ID: P19971
  ENSP ID: ENSP00000252029
MAALMTPGTGAPPAPGDFSGEGSQGLPDPSPEPKQLPELIRMKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 88676 - protein, 482 aa, Homo sapiens; identical to SEQ ID NO: 88675
  Payload ID: 17754
  Gene Name: thymidine phosphorylase
  Uniprot ID: P19971
  ENSP ID: ENSP00000379036

SEQ ID NO: 88677 - protein, 482 aa, Homo sapiens; identical to SEQ ID NO: 88675
  Payload ID: 17754
  Gene Name: thymidine phosphorylase
  Uniprot ID: P19971
  ENSP ID: ENSP00000379037

SEQ ID NO: 88678 - protein, 487 aa, Homo sapiens
  Payload ID: 17754
  Gene Name: thymidine phosphorylase
  Uniprot ID: P19971
  ENSP ID: ENSP00000379038
MAALMTPGTGAPPAPGDFSGEGSQGLPDPSPEPKQLPELIRMKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADAPLPAGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 88679 - protein, 445 aa, Homo sapiens
  Payload ID: 17754
  Gene Name: thymidine phosphorylase
  ENSP ID: ENSP00000395875
MAALMTPGTGAPPAPGDFSGEGSQGLPDPSPEPKQLPELIRMKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVL

SEQ ID NO: 88680 - protein, 279 aa, Homo sapiens
  Payload ID: 17755
  Gene Name: thymidylate synthetase
  Uniprot ID: P04818
  ENSP ID: ENSP00000314727
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 88681 - protein, 230 aa, Homo sapiens
  Payload ID: 17755
  Gene Name: thymidylate synthetase
  Uniprot ID: P04818
  ENSP ID: ENSP00000314902
MPVAGSELPRRPLPPAAQERDAEPRPPHGELQYLGQIQHILRCGVRKDDRTGTGTLSVFGMQARYSLRDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 88682 - protein, 313 aa, Homo sapiens
  Payload ID: 17755
  Gene Name: thymidylate synthetase
  Uniprot ID: P04818
  ENSP ID: ENSP00000315644
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 88683 - protein, 406 aa, Homo sapiens
  Payload ID: 17756
  Gene Name: thymine DNA glycosylase
  ENSP ID: ENSP00000266775
MGECYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 88684 - protein, 410 aa, Homo sapiens
  Payload ID: 17756
  Gene Name: thymine DNA glycosylase
  Uniprot ID: Q13569
  ENSP ID: ENSP00000376611
MEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 88685 - protein, 138 aa, Homo sapiens
  Payload ID: 17756
  Gene Name: thymine DNA glycosylase
  ENSP ID: ENSP00000390167
MAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCL

SEQ ID NO: 88686 - protein, 257 aa, Homo sapiens
  Payload ID: 17756
  Gene Name: thymine DNA glycosylase
  ENSP ID: ENSP00000439825
MEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTET

SEQ ID NO: 88687 - protein, 111 aa, Homo sapiens
  Payload ID: 17756
  Gene Name: thymine DNA glycosylase
  ENSP ID: ENSP00000445716
  MOD_RES (1)..(1): Any amino acid
XITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSRYL

SEQ ID NO: 88688 - protein, 267 aa, Homo sapiens
  Payload ID: 17756
  Gene Name: thymine DNA glycosylase
  ENSP ID: ENSP00000445899
MAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 88689 - protein, 521 aa, Homo sapiens
  Payload ID: 17757
  Gene Name: thymocyte expressed, positive selection associated 1
  Uniprot ID: A2RU30
  ENSP ID: ENSP00000312679
MEASVLSPTSWEKRRAWLRQSRNWQTQVLEEEAAAALQDVPDPEPSSLDDVFQEGNPINKIEDWLQDCGYSEEGFSEEAGQFIYNGFCSHGTSFEDDLTLGAEATLLAANGKLFSRSFLETARPCQLLDLGCSLASSSMTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 88690 - protein, 521 aa, Homo sapiens; identical to SEQ ID NO: 88689
  Payload ID: 17757
  Gene Name: thymocyte expressed, positive selection associated 1
  Uniprot ID: A2RU30
  ENSP ID: ENSP00000400892

SEQ ID NO: 88691 - protein, 383 aa, Homo sapiens
  Payload ID: 17757
  Gene Name: thymocyte expressed, positive selection associated 1
  Uniprot ID: A2RU30
  ENSP ID: ENSP00000432030
MTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 88692 - protein, 383 aa, Homo sapiens; identical to SEQ ID NO: 88691
  Payload ID: 17757
  Gene Name: thymocyte expressed, positive selection associated 1
  Uniprot ID: A2RU30
  ENSP ID: ENSP00000433098

SEQ ID NO: 88693 - protein, 80 aa, Homo sapiens
  Payload ID: 17757
  Gene Name: thymocyte expressed, positive selection associated 1
  ENSP ID: ENSP00000433187
MTGGTNKTSSSISEILDKVQEDAEDVLFSLGFGQEDHKDTSRIPARFFTTPSQAKGIDFQLFLKSQVRRIEMEDPCLMLA

SEQ ID NO: 88694 - protein, 47 aa, Homo sapiens
  Payload ID: 17757
  Gene Name: thymocyte expressed, positive selection associated 1
  ENSP ID: ENSP00000433895
MEASVLSPTSWEKRRAWLRQSRNWQTQVLEEEAAAALQDVPDPEPSS

SEQ ID NO: 88695 - protein, 80 aa, Homo sapiens
  Payload ID: 17757
  Gene Name: thymocyte expressed, positive selection associated 1
  ENSP ID: ENSP00000434039
  MOD_RES (1)..(1): Any amino acid
XASVLSPTSWEKRRAWLRQSRNWQTQVLEEEAAAALQDVPDPEPSSLDDVFQEGNPINKIEDWLQDCGKLNTTDSHWKRI

SEQ ID NO: 88696 - protein, 67 aa, Homo sapiens
  Payload ID: 17757
  Gene Name: thymocyte expressed, positive selection associated 1
  ENSP ID: ENSP00000434811
MTGGTNKTSSSISEILDKVQEDAEDVLFSLGFGQEDHKDTSRIPARFFTTPSQAKGIDFQLFLKSQV

SEQ ID NO: 88697 - protein, 383 aa, Homo sapiens; identical to SEQ ID NO: 88691
  Payload ID: 17757
  Gene Name: thymocyte expressed, positive selection associated 1
  Uniprot ID: A2RU30
  ENSP ID: ENSP00000435622

SEQ ID NO: 88698 - protein, 60 aa, Homo sapiens
  Payload ID: 17757
  Gene Name: thymocyte expressed, positive selection associated 1
  ENSP ID: ENSP00000435734
MTGGTNKTSSSISEILDKVQEDAEDVLFSLGFGQEDHKDTSRIPARFFTTPSQAKGIDFQ

SEQ ID NO: 88699 - protein, 100 aa, Homo sapiens
  Payload ID: 17757
  Gene Name: thymocyte expressed, positive selection associated 1
  ENSP ID: ENSP00000436286
MTGGTNKTSSSISEILDKVQEDAEDVLFSLGFGQEDHKDTSRIPARFFTTPSQAKGIDFQLFLKSQVRRIEMEDPCLMLASFLHHHNSMWSDRIGFKEET

SEQ ID NO: 88700 - protein, 82 aa, Homo sapiens
  Payload ID: 17757
  Gene Name: thymocyte expressed, positive selection associated 1
  ENSP ID: ENSP00000436635
MEASVLSPTSWEKRRAWLRQSRNWQTQVLEEEAAAALQDVPDPEPSSLDDVFQEGNPINKIEDWLQDCGYSEEGFSEEAGQF

SEQ ID NO: 88701 - protein, 149 aa, Homo sapiens
  Payload ID: 17757
  Gene Name: thymocyte expressed, positive selection associated 1
  ENSP ID: ENSP00000436753
QWSTDPAQIRRELCSLPATNTETHPAKDETFWKRKSRARKSLFQKNLMGRKVKSLDLSITQQKWKQSVDRPELRRSLSQQPQDTFDLEEAFSTTTTACGLTELASKKKLKATSCRKLHCPQHPAPTPWSSKPPNSAGERQHGTWGGRPD

SEQ ID NO: 88702 - protein, 394 aa, Homo sapiens
  Payload ID: 17757
  Gene Name: thymocyte expressed, positive selection associated 1
  ENSP ID: ENSP00000478986
MTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKLVKLSPPPQQHVV

SEQ ID NO: 88703 - protein, 166 aa, Homo sapiens
  Payload ID: 17758
  Gene Name: thymocyte nuclear protein 1
  Uniprot ID: Q9P016
  ENSP ID: ENSP00000341452
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMKSLILF

SEQ ID NO: 88704 - protein, 225 aa, Homo sapiens
  Payload ID: 17758
  Gene Name: thymocyte nuclear protein 1
  Uniprot ID: Q9P016
  ENSP ID: ENSP00000341657
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVDVQFVRMMKRFIPLAELKSYHQAHKATGGPLKNMVLFTRQRLSIQPLTQEEFDFVLSLEEKEPS

SEQ ID NO: 88705 - protein, 225 aa, Homo sapiens; identical to SEQ ID NO: 88704
  Payload ID: 17758
  Gene Name: thymocyte nuclear protein 1
  Uniprot ID: Q9P016
  ENSP ID: ENSP00000376373

SEQ ID NO: 88706 - protein, 225 aa, Homo sapiens; identical to SEQ ID NO: 88704
  Payload ID: 17758
  Gene Name: thymocyte nuclear protein 1
  Uniprot ID: Q9P016
  ENSP ID: ENSP00000376374

SEQ ID NO: 88707 - protein, 641 aa, Homo sapiens
  Payload ID: 17759
  Gene Name: thymocyte selection associated
  Uniprot ID: Q8N1K5
  ENSP ID: ENSP00000357231
MALSLEEFVHSLDLRTLPRVLEIQAGIYLEGSIYEMFGNECCFSTGEVIKITGLKVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKRHHVDITKKLHPNQAGLDSKVLIGSQNDLVDEEKERSNRGATAIAETFKNEKHQK

SEQ ID NO: 88708 - protein, 641 aa, Homo sapiens; identical to SEQ ID NO: 88707
  Payload ID: 17759
  Gene Name: thymocyte selection associated
  Uniprot ID: Q8N1K5
  ENSP ID: ENSP00000357233

SEQ ID NO: 88709 - protein, 210 aa, Homo sapiens
  Payload ID: 17759
  Gene Name: thymocyte selection associated
  ENSP ID: ENSP00000387740
  MOD_RES (1)..(1): Any amino acid
XLQTTQGIAMALSLEEFVHSLDLRTLPRVLEIQAGIYLEGSIYEMFGNECCFSTGEVIKITGLKVKKIIAEICEQIEGCESLQPFELPMNFPVRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYD

SEQ ID NO: 88710 - protein, 606 aa, Homo sapiens
  Payload ID: 17759
  Gene Name: thymocyte selection associated
  Uniprot ID: Q8N1K5
  ENSP ID: ENSP00000439863
MFGNECCFSTGEVIKITGLKVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKRHHVDITKKLHPNQAGLDSKVLIGSQNDLVDEEKERSNRGATAIAETFKNEKHQK

SEQ ID NO: 88711 - protein, 641 aa, Homo sapiens; identical to SEQ ID NO: 88707
  Payload ID: 17759
  Gene Name: thymocyte selection associated
  Uniprot ID: Q8N1K5
  ENSP ID: ENSP00000480630

SEQ ID NO: 88712 - protein, 641 aa, Homo sapiens; identical to SEQ ID NO: 88707
  Payload ID: 17759
  Gene Name: thymocyte selection associated
  Uniprot ID: Q8N1K5
  ENSP ID: ENSP00000480967

SEQ ID NO: 88713 - protein, 606 aa, Homo sapiens; identical to SEQ ID NO: 88710
  Payload ID: 17759
  Gene Name: thymocyte selection associated
  Uniprot ID: Q8N1K5
  ENSP ID: ENSP00000484170

SEQ ID NO: 88714 - protein, 210 aa, Homo sapiens; identical to SEQ ID NO: 88709
  Payload ID: 17759
  Gene Name: thymocyte selection associated
  ENSP ID: ENSP00000486042
  MOD_RES (1)..(1): Any amino acid

SEQ ID NO: 88715 - protein, 562 aa, Homo sapiens
  Payload ID: 17759
  Gene Name: thymocyte selection associated
  ENSP ID: ENSP00000486494
MNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKRHHVDITKKLHPNQAGLDSKVLIGSQNDLVDEEKERSNRGATAIAETFKNEKHQK

SEQ ID NO: 88716 - protein, 680 aa, Homo sapiens
  Payload ID: 17759
  Gene Name: thymocyte selection associated
  Uniprot ID: Q8N1K5
  ENSP ID: ENSP00000487358
MALSLEEFVHSLDLRTLPRVLEIQAGIYLEGSIYEMFGNECCFSTGEVIKITGLKVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKAGVQWRDLGSLQPLPPGFKQFSASASHVAGITGTPHHVQRHHVDITKKLHPNQAGLDSKVLIGSQNDLVDEEKERSNRGATAIAETFKNEKHQK

SEQ ID NO: 88717 - protein, 514 aa, Homo sapiens
  Payload ID: 17760
  Gene Name: thymocyte selection associated family member 2
  Uniprot ID: Q5TEJ8
  ENSP ID: ENSP00000329862
MEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSEVLAWEGPFPLSMEILERLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVKAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 88718 - protein, 643 aa, Homo sapiens
  Payload ID: 17760
  Gene Name: thymocyte selection associated family member 2
  Uniprot ID: Q5TEJ8
  ENSP ID: ENSP00000363031
MEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAHGAQGSDVDVLVCQRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVKAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 88719 - protein, 260 aa, Homo sapiens
  Payload ID: 17760
  Gene Name: thymocyte selection associated family member 2
  Uniprot ID: Q5TEJ8
  ENSP ID: ENSP00000363035
MEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHIFSSLRIAATRSAAQTQGEDLARVHQGWLQYVQQDSCPQEGPQAR

SEQ ID NO: 88720 - protein, 123 aa, Homo sapiens
  Payload ID: 17760
  Gene Name: thymocyte selection associated family member 2
  Uniprot ID: Q5TEJ8
  ENSP ID: ENSP00000363037
MEPVPLQDFVRALDPASLPRVLRVCSGVYFEGSIYEISGNECCLSTGDLIKVTQVRLQKVVCENPKTSQTMELAPNFQVFSSLRIAATRSAAQTQGEDLARVHQGWLQYVQQDSCPQEGPQAR

SEQ ID NO: 88721 - protein, 133 aa, Homo sapiens
  Payload ID: 17760
  Gene Name: thymocyte selection associated family member 2
  ENSP ID: ENSP00000392414
MEPVPLQDFVRALDPASLPRVLRVCSGVYFEGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQ

SEQ ID NO: 88722 - protein, 391 aa, Homo sapiens
  Payload ID: 17760
  Gene Name: thymocyte selection associated family member 2
  ENSP ID: ENSP00000398049
  MOD_RES (1)..(1): Any amino acid
XTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSERLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVKAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 88723 - protein, 246 aa, Homo sapiens
  Payload ID: 17760
  Gene Name: thymocyte selection associated family member 2
  ENSP ID: ENSP00000413725
MEPVPLQDFVRALDPASLPRVLRVCSGVYFEGSIYEISGNECCLSTGDLIKVTQVRLQKVVCENPKTSQTMELAPNFQVRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAH

SEQ ID NO: 88724 - protein, 526 aa, Homo sapiens
  Payload ID: 17761
  Gene Name: thymocyte selection-associated high mobility group box
  Uniprot ID: O94900
  ENSP ID: ENSP00000354842
MDVRFYPPPAQPAAAPDAPCLGPSPCLDPYYCNKFDGENMYMSMTEPSQDYVPASQSYPGPSLESEDFNIPPITPPSLPDHSLVHLNEVESGYHSLCHPMNHNGLLPFHPQNMDLPEITVSNMLGQDGTLLSNSISVMPDIRNPEGTQYSSHPQMAAMRPRGQPADIRQQPGMMPHGQLTTINQSQLSAQLGLNMGGSNVPHNSPSPPGSKSATPSPSSSVHEDEGDDTSKINGGEKRPASDMGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHSALYLSSHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 88725 - protein, 248 aa, Homo sapiens
  Payload ID: 17762
  Gene Name: thymopoietin
  Uniprot ID: P42167
  ENSP ID: ENSP00000261210
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVSLVLLPPCTGINNLLTTLIHVLAFNG

SEQ ID NO: 88726 - protein, 694 aa, Homo sapiens
  Payload ID: 17762
  Gene Name: thymopoietin
  Uniprot ID: P42166
  ENSP ID: ENSP00000266732
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEGKKKEHKKVKSTRDIVPFSELGTTPSGGGFFQGISFPEISTRPPLGSTELQAAKKVHTSKGDLPREPLVATNLPGRGQLQKLASERNLFISCKSSHDRCLEKSSSSSSQPEHSAMLVSTAASPSLIKETTTGYYKDIVENICGREKSGIQPLCPERSHISDQSPLSSKRKALEESESSQLISPPLAQAIRDYVNSLLVQGGVGSLPGTSNSMPPLDVENIQKRIDQSKFQETEFLSPPRKVPRLSEKSVEERDSGSFVAFQNIPGSELMSSFAKTVVSHSLTTLGLEVAKQSQHDKIDASELSFPFHESILKVIEEEWQQVDRQLPSLACKYPVSSREATQILSVPKVDDEILGFISEATPLGGIQAASTESCNQQLDLALCRAYEAAASALQIATHTAFVAKAMQADISQAAQILSSDPSRTHQALGILSKTYDAASYICEAAFDEVKMAAHTMGNATVGRRYLWLKDCKINLASKNKLASTPFKGGTLFGGEVCKVIKKRGNKH

SEQ ID NO: 88727 - protein, 414 aa, Homo sapiens
  Payload ID: 17762
  Gene Name: thymopoietin
  ENSP ID: ENSP00000340251
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 88728 - protein, 345 aa, Homo sapiens
  Payload ID: 17762
  Gene Name: thymopoietin
  Uniprot ID: P42167
  ENSP ID: ENSP00000376773
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 88729 - protein, 454 aa, Homo sapiens
  Payload ID: 17762
  Gene Name: thymopoietin
  Uniprot ID: P42167
  ENSP ID: ENSP00000450627
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 88730 - protein, 237 aa, Homo sapiens
  Payload ID: 17762
  Gene Name: thymopoietin
  ENSP ID: ENSP00000451552
KATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKS

SEQ ID NO: 88731 - protein, 44 aa, Homo sapiens
  Payload ID: 17763
  Gene Name: thymosin beta 10
  Uniprot ID: P63313
  ENSP ID: ENSP00000233143
MADKPDMGEIASFDKAKLKKTETQEKNTLPTKETIEQEKRSEIS

SEQ ID NO: 88732 - protein, 45 aa, Homo sapiens; identical to SEQ ID NO: 75919
  Payload ID: 17764
  Gene Name: thymosin beta 15a
  Uniprot ID: P0CG34
  ENSP ID: ENSP00000289373

SEQ ID NO: 88733 - protein, 45 aa, Homo sapiens; identical to SEQ ID NO: 75919
  Payload ID: 17765
  Gene Name: thymosin beta 15B
  Uniprot ID: P0CG35
  ENSP ID: ENSP00000455371

SEQ ID NO: 88734 - protein, 45 aa, Homo sapiens; identical to SEQ ID NO: 75919
  Payload ID: 17765
  Gene Name: thymosin beta 15B
  Uniprot ID: P0CG35
  ENSP ID: ENSP00000455771

SEQ ID NO: 88735 - protein, 45 aa, Homo sapiens; identical to SEQ ID NO: 75919
  Payload ID: 17765
  Gene Name: thymosin beta 15B
  Uniprot ID: P0CG35
  ENSP ID: ENSP00000456121

SEQ ID NO: 88736 - protein, 45 aa, Homo sapiens; identical to SEQ ID NO: 75919
  Payload ID: 17765
  Gene Name: thymosin beta 15B
  Uniprot ID: P0CG35
  ENSP ID: ENSP00000457057

SEQ ID NO: 88737 - protein, 45 aa, Homo sapiens
  Payload ID: 17765
  Gene Name: thymosin beta 15B
  ENSP ID: ENSP00000457524
MSDKPDLSEVEKFDRSKLKKTNTEEKNTLPSKEIFFSLVGVNIQD

SEQ ID NO: 88738 - protein, 44 aa, Homo sapiens
  Payload ID: 17766
  Gene Name: thymosin beta 4, X-linked
  Uniprot ID: P62328
  ENSP ID: ENSP00000370007
MSDKPDMAEIEKFDKSKLKKTETQEKNPLPSKETIEQEKQAGES

SEQ ID NO: 88739 - protein, 44 aa, Homo sapiens; identical to SEQ ID NO: 88738
  Payload ID: 17766
  Gene Name: thymosin beta 4, X-linked
  Uniprot ID: P62328
  ENSP ID: ENSP00000370009

SEQ ID NO: 88740 - protein, 44 aa, Homo sapiens; identical to SEQ ID NO: 88738
  Payload ID: 17766
  Gene Name: thymosin beta 4, X-linked
  Uniprot ID: P62328
  ENSP ID: ENSP00000370010

SEQ ID NO: 88741 - protein, 44 aa, Homo sapiens; identical to SEQ ID NO: 88738
  Payload ID: 17766
  Gene Name: thymosin beta 4, X-linked
  Uniprot ID: P62328
  ENSP ID: ENSP00000414376

SEQ ID NO: 88742 - protein, 44 aa, Homo sapiens
  Payload ID: 17767
  Gene Name: thymosin beta 4, Y-linked
  Uniprot ID: O14604
  ENSP ID: ENSP00000284856
MSDKPGMAEIEKFDKSKLKKTETQEKNPLSSKETIEQERQAGES

SEQ ID NO: 88743 - protein, 351 aa, Homo sapiens
  Payload ID: 17768
  Gene Name: thymus, brain and testes associated
  Uniprot ID: Q96M53
  ENSP ID: ENSP00000299290
MATDVQLADYPLMSPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSEAWKKELKELASRVAFLTKEDELKKKEKEQKEEPLREQGAKYSAETGRLIPASTRAVGRRRSHQGQQSQSSSRHEGVQAFLLQDQELLVLELLCRILETDLLSAIQFWLLYAPPKEKDLALGLLQTAVAQLLPQPLVSIPTEKLLSQLPEVHEPPQEKQEPPCSQSPKKTKISPFTKSEKPEYIGEAQVLQMHSSQNTEKKTSKPRAES

SEQ ID NO: 88744 - protein, 352 aa, Homo sapiens
  Payload ID: 17768
  Gene Name: thymus, brain and testes associated
  ENSP ID: ENSP00000400224
MATDVQLADYPLMSPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSEAWKKELKELASRVAFLTKEDELKKKEQKEQKEEPLREQGAKYSAETGRLIPASTRAVGRRRSHQGQQSQSSSRHEGVQAFLLQDQELLVLELLCRILETDLLSAIQFWLLYAPPKEKDLALGLLQTAVAQLLPQPLVSIPTEKLLSQLPEVHEPPQEKQEPPCSQSPKKTKISPFTKSEKPEYIGEAQVLQMHSSQNTEKKTSKPRAES

SEQ ID NO: 88745 - protein, 2768 aa, Homo sapiens
  Payload ID: 17769
  Gene Name: thyroglobulin
  Uniprot ID: P01266
  ENSP ID: ENSP00000220616
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 88746 - protein, 59 aa, Homo sapiens
  Payload ID: 17769
  Gene Name: thyroglobulin
  ENSP ID: ENSP00000427871
MALVLEIFTLLASICWVSANIFEYQVDAQPLRPCELQRETAFLKQADYVPQCAEDGSFQ

SEQ ID NO: 88747 - protein, 147 aa, Homo sapiens
  Payload ID: 17769
  Gene Name: thyroglobulin
  ENSP ID: ENSP00000428628
  MOD_RES (1)..(1): Any amino acid
XSAGASALLRSGPYMPQCDAFGSWEPVQCHAGTGHCWCVDEKGGFIPGSLTARSLQIPQCPTTCEKSRTSGLLSSWKQARSQENPSPKDLFVPACLEARGVRCHSTRRRWLVEQSCVRQSRAPQALPCSSANCCAARAPGACFHQGH

SEQ ID NO: 88748 - protein, 62 aa, Homo sapiens
  Payload ID: 17769
  Gene Name: thyroglobulin
  ENSP ID: ENSP00000429164
  MOD_RES (1)..(1): Any amino acid
XSDMGSRPESMGCRKDTVPRPASPTEAGCVQEHSFCQLAEITESASLYFTCTLYPEAQVCDD

SEQ ID NO: 88749 - protein, 226 aa, Homo sapiens
  Payload ID: 17769
  Gene Name: thyroglobulin
  ENSP ID: ENSP00000429605
  MOD_RES (1)..(1): Any amino acid
XGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQSCRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQ

SEQ ID NO: 88750 - protein, 194 aa, Homo sapiens
  Payload ID: 17769
  Gene Name: thyroglobulin
  ENSP ID: ENSP00000429761
  MOD_RES (1)..(1): Any amino acid
XHSECQWREHSLRPLPFLTPFSSLSQQESLCSAMRHLYLLCPFPPMAGCWAGPRPSRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLT

SEQ ID NO: 88751 - protein, 74 aa, Homo sapiens
  Payload ID: 17769
  Gene Name: thyroglobulin
  ENSP ID: ENSP00000430087
  MOD_RES (1)..(1): Any amino acid
XGIQMCSEENGGAWRILDCGSPDIEVHTYPFGWYQKPIAQNNAPSFCPLVVLPSLTEKVFKVREVRGTQLKRME

SEQ ID NO: 88752 - protein, 172 aa, Homo sapiens
  Payload ID: 17769
  Gene Name: thyroglobulin
  ENSP ID: ENSP00000430161
SDARVEAAATWYYSLEHSTDDYASFSRALENATRDYFIICPIIDMASAWAKRARGNVFMYHAPENYGHGRNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 88753 - protein, 901 aa, Homo sapiens
  Payload ID: 17769
  Gene Name: thyroglobulin
  ENSP ID: ENSP00000430430
MLPGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPMSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 88754 - protein, 1224 aa, Homo sapiens
  Payload ID: 17769
  Gene Name: thyroglobulin
  ENSP ID: ENSP00000430523
  MOD_RES (1)..(1): Any amino acid
XQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 88755 - protein, 297 aa, Homo sapiens
  Payload ID: 17770
  Gene Name: thyroid adenoma associated
  ENSP ID: ENSP00000381647
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLCAASFSGLHQCPRVVYEQLQEPLLW

SEQ ID NO: 88756 - protein, 297 aa, Homo sapiens; identical to SEQ ID NO: 88755
  Payload ID: 17770
  Gene Name: thyroid adenoma associated
  ENSP ID: ENSP00000384172

SEQ ID NO: 88757 - protein, 894 aa, Homo sapiens
  Payload ID: 17770
  Gene Name: thyroid adenoma associated
  Uniprot ID: Q6YHU6
  ENSP ID: ENSP00000384266
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMGLY

SEQ ID NO: 88758 - protein, 408 aa, Homo sapiens
  Payload ID: 17770
  Gene Name: thyroid adenoma associated
  ENSP ID: ENSP00000385003
LLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQLSNA

SEQ ID NO: 88759 - protein, 937 aa, Homo sapiens
  Payload ID: 17770
  Gene Name: thyroid adenoma associated
  Uniprot ID: Q6YHU6
  ENSP ID: ENSP00000385441
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLK

SEQ ID NO: 88760 - protein, 870 aa, Homo sapiens
  Payload ID: 17770
  Gene Name: thyroid adenoma associated
  ENSP ID: ENSP00000385469
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGKCLIMLGEVIFVFFQNILILHFALFEVSVLLPFFEVSFLPYNSCLYIMKFASKGQKRKKLSPFSLIIICQPQSIIFMDYAYYGKSSSYYLTNLFVAVLR

SEQ ID NO: 88761 - protein, 1953 aa, Homo sapiens
  Payload ID: 17770
  Gene Name: thyroid adenoma associated
  Uniprot ID: Q6YHU6
  ENSP ID: ENSP00000385995
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 88762 - protein, 1953 aa, Homo sapiens; identical to SEQ ID NO: 88761
  Payload ID: 17770
  Gene Name: thyroid adenoma associated
  Uniprot ID: Q6YHU6
  ENSP ID: ENSP00000386088

SEQ ID NO: 88763 - protein, 1193 aa, Homo sapiens
  Payload ID: 17770
  Gene Name: thyroid adenoma associated
  ENSP ID: ENSP00000386112
  MOD_RES (1)..(1): Any amino acid
XKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 88764 - protein, 348 aa, Homo sapiens
  Payload ID: 17770
  Gene Name: thyroid adenoma associated
  ENSP ID: ENSP00000445294
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQVL

SEQ ID NO: 88765 - protein, 955 aa, Homo sapiens
  Payload ID: 17771
  Gene Name: thyroid hormone receptor associated protein 3
  Uniprot ID: Q9Y2W1
  ENSP ID: ENSP00000346634
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEAKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 88766 - protein, 40 aa, Homo sapiens
  Payload ID: 17771
  Gene Name: thyroid hormone receptor associated protein 3
  ENSP ID: ENSP00000433066
MSKTNKSKSGSRSSRSRSASRSRSRSFSKSRSRSRSLSRS

SEQ ID NO: 88767 - protein, 955 aa, Homo sapiens; identical to SEQ ID NO: 88765
  Payload ID: 17771
  Gene Name: thyroid hormone receptor associated protein 3
  Uniprot ID: Q9Y2W1
  ENSP ID: ENSP00000433825

SEQ ID NO: 88768 - protein, 601 aa, Homo sapiens
  Payload ID: 17772
  Gene Name: thyroid hormone receptor interactor 10
  Uniprot ID: Q15642
  ENSP ID: ENSP00000320117
MDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPRPPPLSPLGGPVPSALPNGPPSPRSGRDPLAILSEISKSVKPRLASFRSLRGSRGTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 88769 - protein, 545 aa, Homo sapiens
  Payload ID: 17772
  Gene Name: thyroid hormone receptor interactor 10
  Uniprot ID: Q15642
  ENSP ID: ENSP00000320493
MDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 88770 - protein, 593 aa, Homo sapiens
  Payload ID: 17772
  Gene Name: thyroid hormone receptor interactor 10
  ENSP ID: ENSP00000469360
MDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEDLGPPPPPSQGPARALSLWPRVKTSVLWKKTKGTAGPGSGGKREARATCPPPTSESRSIEPCQRREEGGCRLLLLGHGEPQDLCTLFLTPWLRLRPV

SEQ ID NO: 88771 - protein, 83 aa, Homo sapiens
  Payload ID: 17772
  Gene Name: thyroid hormone receptor interactor 10
  ENSP ID: ENSP00000471056
MKQERKMHFQEGRRAQQQLENGFKQLENSKRKFERDCREAEKAAQTAERLDQDINATKADVEKAKQQAHLRSHMAEESKNEYA

SEQ ID NO: 88772 - protein, 437 aa, Homo sapiens
  Payload ID: 17772
  Gene Name: thyroid hormone receptor interactor 10
  ENSP ID: ENSP00000471203
MKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 88773 - protein, 343 aa, Homo sapiens
  Payload ID: 17772
  Gene Name: thyroid hormone receptor interactor 10
  ENSP ID: ENSP00000472580
MDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPSRQPWALYPPCRQW

SEQ ID NO: 88774 - protein, 1979 aa, Homo sapiens
  Payload ID: 17773
  Gene Name: thyroid hormone receptor interactor 11
  Uniprot ID: Q15643
  ENSP ID: ENSP00000267622
MSSWLGGLGSGLGQSLGQVGGSLASLTGQISNFTKDMLMEGTEEVEAELPDSRTKEIEAIHAILRSENERLKKLCTDLEEKHEASEIQIKQQSTSYRNQLQQKEVEISHLKARQIALQDQLLKLQSAAQSVPSGAGVPATTASSSFAYGISHHPSAFHDDDMDFGDIISSQQEINRLSNEVSRLESEVGHWRHIAQTSKAQGTDNSDQSEICKLQNIIKELKQNRSQEIDDHQHEMSVLQNAHQQKLTEISRRHREELSDYEERIEELENLLQQGGSGVIETDLSKIYEMQKTIQVLQIEKVESTKKMEQLEDKIKDINKKLSSAENDRDILRREQEQLNVEKRQIMEECENLKLECSKLQPSAVKQSDTMTEKERILAQSASVEEVFRLQQALSDAENEIMRLSSLNQDNSLAEDNLKLKMRIEVLEKEKSLLSQEKEELQMSLLKLNNEYEVIKSTATRDISLDSELHDLRLNLEAKEQELNQSISEKETLIAEIEELDRQNQEATKHMILIKDQLSKQQNEGDSIISKLKQDLNDEKKRVHQLEDDKMDITKELDVQKEKLIQSEVALNDLHLTKQKLEDKVENLVDQLNKSQESNVSIQKENLELKEHIRQNEEELSRIRNELMQSLNQDSNSNFKDTLLKEREAEVRNLKQNLSELEQLNENLKKVAFDVKMENEKLVLACEDVRHQLEECLAGNNQLSLEKNTIVETLKMEKGEIEAELCWAKKRLLEEANKYEKTIEELSNARNLNTSALQLEHEHLIKLNQKKDMEIAELKKNIEQMDTDHKETKDVLSSSLEEQKQLTQLINKKEIFIEKLKERSSKLQEELDKYSQALRKNEILRQTIEEKDRSLGSMKEENNHLQEELERLREEQSRTAPVADPKTLDSVTELASEVSQLNTIKEHLEEEIKHHQKIIEDQNQSKMQLLQSLQEQKKEMDEFRYQHEQMNATHTQLFLEKDEEIKSLQKTIEQIKTQLHEERQDIQTDNSDIFQETKVQSLNIENGSEKHDLSKAETERLVKGIKERELEIKLLNEKNISLTKQIDQLSKDEVGKLTQIIQQKDLEIQALHARISSTSHTQDVVYLQQQLQAYAMEREKVFAVLNEKTRENSHLKTEYHKMMDIVAAKEAALIKLQDENKKLSTRFESSGQDMFRETIQNLSRIIREKDIEIDALSQKCQTLLAVLQTSSTGNEAGGVNSNQFEELLQERDKLKQQVKKMEEWKQQVMTTVQNMQHESAQLQEELHQLQAQVLVDSDNNSKLQVDYTGLIQSYEQNETKLKNFGQELAQVQHSIGQLCNTKDLLLGKLDIISPQLSSASLLTPQSAECLRASKSEVLSESSELLQQELEELRKSLQEKDATIRTLQENNHRLSDSIAATSELERKEHEQTDSEIKQLKEKQDVLQKLLKEKDLLIKAKSDQLLSSNENFTNKVNENELLRQAVTNLKERILILEMDIGKLKGENEKIVETYRGKETEYQALQETNMKFSMMLREKEFECHSMKEKALAFEQLLKEKEQGKTGELNQLLNAVKSMQEKTVVFQQERDQVMLALKQKQMENTALQNEVQRLRDKEFRSNQELERLRNHLLESEDSYTREALAAEDREAKLRKKVTVLEEKLVSSSNAMENASHQASVQVESLQEQLNVVSKQRDETALQLSVSQEQVKQYALSLANLQMVLEHFQQEEKAMYSAELEKQKQLIAEWKKNAENLEGKVISLQECLDEANAALDSASRLTEQLDVKEEQIEELKRQNELRQEMLDDVQKKLMSLANSSEGKVDKVLMRNLFIGHFHTPKNQRHEVLRLMGSILGVRREEMEQLFHDDQGGVTRWMTGWLGGGSKSVPNTPLRPNQQSVVNSSFSELFVKFLETESHPSIPPPKLSVHDMKPLDSPGRRKRDTNAPESFKDTAESRSGRRTDVNPFLAPRSAAVPLINPAGLGPGGPGHLLLKPISDVLPTFTPLPALPDNSAGVVLKDLLKQ

SEQ ID NO: 88775 - protein, 1695 aa, Homo sapiens
  Payload ID: 17773
  Gene Name: thyroid hormone receptor interactor 11
  ENSP ID: ENSP00000451032
  MOD_RES (1)..(1): Any amino acid
XELSDYEERIEELENLLQQGGSGVIETDLSKIYEMQKTIQVLQIEKVESTKKMEQLEDKIKDINKKLSSAENDRDILRREQEQLNVEKRQIMEECENLKLECSKLQPSAVKQSDTMTEKERILAQSASVEEVFRLQQALSDAENEIMRLSSLNQEELQMSLLKLNNEYEVIKSTATRDISLDSELHDLRLNLEAKEQELNQSISEKETLIAEIEELDRQNQEATKHMILIKDQLSKQQNEGDSIISKLKQDLNDEKKRVHQLEDDKMDITKELDVQKEKLIQSEVALNDLHLTKQKLEDKVENLVDQLNKSQESNVSIQKENLELKEHIRQNEEELSRIRNELMQSLNQDSNSNFKDTLLKEREAEVRNLKQNLSELEQLNENLKKVAFDVKMENEKLVLACEDVRHQLEECLAGNNQLSLEKNTIVETLKMEKGEIEAELCWAKKRLLEEANKYEKTIEELSNARNLNTSALQLEHEHLIKLNQKKDMEIAELKKNIEQMDTDHKETKDVLSSSLEEQKQLTQLINKKEIFIEKLKERSSKLQEELDKYSQALRKNEILRQTIEEKDRSLGSMKEENNHLQEELERLREEQSRTAPVADPKTLDSVTELASEVSQLNTIKEHLEEEIKHHQKIIEDQNQSKMQLLQSLQEQKKEMDEFRYQHEQMNATHTQLFLEKDEEIKSLQKTIEQIKTQLHEERQDIQTDNSDIFQETKVQSLNIENGSEKHDLSKAETERLVKGIKERELEIKLLNEKNISLTKQIDQLSKDEVGKLTQIIQQKDLEIQALHARISSTSHTQDVVYLQQQLQAYAMEREKVFAVLNEKTRENSHLKTEYHKMMDIVAAKEAALIKLQDENKKLSTRFESSGQDMFRETIQNLSRIIREKDIEIDALSQKCQTLLAVLQTSSTGNEAGGVNSNQFEELLQERDKLKQQVKKMEEWKQQVMTTVQNMQHESAQLQEELHQLQAQVLVDSDNNSKLQVDYTGLIQSYEQNETKLKNFGQELAQVQHSIGQLCNTKDLLLGKLDIISPQLSSASLLTPQSAECLRASKSEVLSESSELLQQELEELRKSLQEKDATIRTLQENNHRLSDSIAATSELERKEHEQTDSEIKQLKEKQDVLQKLLKEKDLLIKAKSDQLLSSNENFTNKVNENELLRQAVTNLKERILILEMDIGKLKGENEKIVETYRGKETEYQALQETNMKFSMMLREKEFECHSMKEKALAFEQLLKEKEQGKTGELNQLLNAVKSMQEKTVVFQQERDQVMLALKQKQMENTALQNEVQRLRDKEFRSNQELERLRNHLLESEDSYTREALAAEDREAKLRKKVTVLEEKLVSSSNAMENASHQASVQVESLQEQLNVVSKQRDETALQLSVSQEQVKQYALSLANLQMVLEHFQQEEKAMYSAELEKQKQLIAEWKKNAENLEGKVISLQECLDEANAALDSASRLTEQLDVKEEQIEELKRQNELRQEMLDDVQKKLMSLANSSEGKVDKVLMRNLFIGHFHTPKNQRHEVLRLMGSILGVRREEMEQLFHDDQGGVTRWMTGWLGGGSKSVPNTPLRPNQQSVVNSSFSELFVKFLETESHPSIPPPKLSVHDMKPLDSPGRRKRDTNAPESFKDTAESRSGRRTDVNPFLAPRSAAVPLINPAGLGPGGPGHLLLKPISDVLPTFTPLPALPDNSAGVVLKDLLKQ

SEQ ID NO: 88776 - protein, 176 aa, Homo sapiens
  Payload ID: 17773
  Gene Name: thyroid hormone receptor interactor 11
  ENSP ID: ENSP00000451607
RNHLLESEDSYTREALAAEDREAKLRKKVTVLEEKLVSSSNAMENASHQASVQVESLQEQLNVVSKQRDETALQLSVSQEQVKQYALSLANLQMVLEHFQQEEKAMYSAELEKQKQLIAEWKKNAENLEGKVISLQECLDEANAALDSASRLTEQLDVKEEQIEELKRQNIIKKVR

SEQ ID NO: 88777 - protein, 67 aa, Homo sapiens
  Payload ID: 17773
  Gene Name: thyroid hormone receptor interactor 11
  ENSP ID: ENSP00000451944
MDFGDIISSQQEINRLSNEVSRLESEVGHWRHIAQTSKAQGTDNSDQSEICKLQNIIKELKQNRSQE

SEQ ID NO: 88778 - protein, 1992 aa, Homo sapiens
  Payload ID: 17774
  Gene Name: thyroid hormone receptor interactor 12
  Uniprot ID: Q14669
  ENSP ID: ENSP00000283943
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQSKTGGSSKFDWAARFSPKVSLPKTKLSLPGSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 88779 - protein, 99 aa, Homo sapiens
  Payload ID: 17774
  Gene Name: thyroid hormone receptor interactor 12
  ENSP ID: ENSP00000342442
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTE

SEQ ID NO: 88780 - protein, 2040 aa, Homo sapiens
  Payload ID: 17774
  Gene Name: thyroid hormone receptor interactor 12
  Uniprot ID: Q14669
  ENSP ID: ENSP00000373696
MSNRPNNNPGGSLRRSQRNTAGAQPQDDSIGGRSHLGQAKHKGYSPPESRKSNSKAPKVQSNTTSELSRGHLSKRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQSKTGGSSKFDWAARFSPKVSLPKTKLSLPGSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAASSSVAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 88781 - protein, 1722 aa, Homo sapiens
  Payload ID: 17774
  Gene Name: thyroid hormone receptor interactor 12
  Uniprot ID: Q14669
  ENSP ID: ENSP00000373697
MSNRPNNNPGGSLRRSQRNTAGAQPQDDSIGGSRRGSGLGKRGAAEARRQEKMADPESNQEAVNSSAARTDEAPQGAAASSSVAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 88782 - protein, 430 aa, Homo sapiens
  Payload ID: 17774
  Gene Name: thyroid hormone receptor interactor 12
  ENSP ID: ENSP00000386388
MSNRPNNNPGGSLRRSQRNTAGAQPQDDSIGGRSHLGQAKHKGYSPPESRKSNSKAPKVQSNTTSELSRGHLSKRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQSKTGGSSKFDWAARFSPKVSLPKTKLSLPGSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAEEGFRTS

SEQ ID NO: 88783 - protein, 190 aa, Homo sapiens
  Payload ID: 17774
  Gene Name: thyroid hormone receptor interactor 12
  ENSP ID: ENSP00000389827
MSNRPNNNPGGSLRRSQRNTAGAQPQDDSIGGRSHLGQAKHKGYSPPESRKSNSKAPKVQSNTTSELSRGHLSKRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQK

SEQ ID NO: 88784 - protein, 217 aa, Homo sapiens
  Payload ID: 17774
  Gene Name: thyroid hormone receptor interactor 12
  ENSP ID: ENSP00000400967
SKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEA

SEQ ID NO: 88785 - protein, 187 aa, Homo sapiens
  Payload ID: 17774
  Gene Name: thyroid hormone receptor interactor 12
  ENSP ID: ENSP00000408330
LMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLDQLLCGSKADTWDAKTLMECCRPDHGYTHDSRAVKFLFEILSSFDNEQQRLFLQFVTGSPRLPVG

SEQ ID NO: 88786 - protein, 154 aa, Homo sapiens
  Payload ID: 17774
  Gene Name: thyroid hormone receptor interactor 12
  ENSP ID: ENSP00000409460
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTES

SEQ ID NO: 88787 - protein, 149 aa, Homo sapiens
  Payload ID: 17774
  Gene Name: thyroid hormone receptor interactor 12
  ENSP ID: ENSP00000414385
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKR

SEQ ID NO: 88788 - protein, 432 aa, Homo sapiens
  Payload ID: 17775
  Gene Name: thyroid hormone receptor interactor 13
  Uniprot ID: Q15645
  ENSP ID: ENSP00000166345
MDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 88789 - protein, 249 aa, Homo sapiens
  Payload ID: 17775
  Gene Name: thyroid hormone receptor interactor 13
  ENSP ID: ENSP00000427528
  MOD_RES (1)..(1): Any amino acid
XGVGGTQRRGQTFTDPPYVHGGWIEVSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDE

SEQ ID NO: 88790 - protein, 581 aa, Homo sapiens
  Payload ID: 17776
  Gene Name: thyroid hormone receptor interactor 4
  Uniprot ID: Q15650
  ENSP ID: ENSP00000261884
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKDVEFPNDYPSGCLLGCVDLIDCLSQKQFKEQFPDISQESDSPFVFICKNPQEMVVKFPIKGNPKIWKLDSKIHQGAKKGLMKQNKAV

SEQ ID NO: 88791 - protein, 43 aa, Homo sapiens
  Payload ID: 17776
  Gene Name: thyroid hormone receptor interactor 4
  ENSP ID: ENSP00000452675
MAVAGAVSGEPLVHWCTQQLRKTFGLDVSEEIIQEMKAKKVNS

SEQ ID NO: 88792 - protein, 111 aa, Homo sapiens
  Payload ID: 17776
  Gene Name: thyroid hormone receptor interactor 4
  ENSP ID: ENSP00000452764
  MOD_RES (1)..(1): Any amino acid
XSELQATYRLLRGKDVEFPNDYPSGCLLGCVDLIDCLSQKQFKEQFPDISQESDSPFVFICKNPQEMVVKFPIKGNPKICSLEDERTSEFLGISWKSLFLLYLVSPISFPF

SEQ ID NO: 88793 - protein, 368 aa, Homo sapiens
  Payload ID: 17776
  Gene Name: thyroid hormone receptor interactor 4
  ENSP ID: ENSP00000453106
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSSGLTTQVQPHRRRLSVLQDLD

SEQ ID NO: 88794 - protein, 126 aa, Homo sapiens
  Payload ID: 17776
  Gene Name: thyroid hormone receptor interactor 4
  ENSP ID: ENSP00000453276
MAVAGAVSGEPLVHWCTQQLRKTFGLDVSEEIIQYVLSIESAEEIREYVTDLLQGNEGKKGQFIEELITKWQKNDQELISDPLQQCFKKDGTREQQLRKEEDKVCQFIHKRGTGQACSPAPWSSPL

SEQ ID NO: 88795 - protein, 61 aa, Homo sapiens
  Payload ID: 17776
  Gene Name: thyroid hormone receptor interactor 4
  ENSP ID: ENSP00000454558
  MOD_RES (1)..(1): Any amino acid
XELRELRHASRLSKKVTIDFAGRKILEEENSLAEYHSSFQTSVKSLILHLFSSAKILRKWL

SEQ ID NO: 88796 - protein, 476 aa, Homo sapiens
  Payload ID: 17777
  Gene Name: thyroid hormone receptor interactor 6
  Uniprot ID: Q15654
  ENSP ID: ENSP00000200457
MSGPTWLPPKQPEPARAPQGRAIPRGTPGPPPAHGAALQPHPRVNFCPLPSEQCYQAPGGPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVATLEKCATCSQPILDRILRAMGKAYHPGCFTCVVCHRGLDGIPFTVDATSQIHCIEDFHRKFAPRCSVCGGAIMPEPGQEETVRIVALDRSFHIGCYKCEECGLLLSSEGECQGCYPLDGHILCKACSAWRIQELSATVTTDC

SEQ ID NO: 88797 - protein, 215 aa, Homo sapiens
  Payload ID: 17777
  Gene Name: thyroid hormone receptor interactor 6
  ENSP ID: ENSP00000389194
  MOD_RES (1)..(1): Any amino acid
XAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVSRSVAQTGVQWGDLCSLQPQPALVQAILMPQAPEQLGLQATLEKCATCSQPILDRILRAMGKAYHPGCFTCVVCHRGLDGIPFTVDATSQIHCIEDFHRKFAPRCSVC

SEQ ID NO: 88798 - protein, 80 aa, Homo sapiens
  Payload ID: 17777
  Gene Name: thyroid hormone receptor interactor 6
  Uniprot ID: Q15654
  ENSP ID: ENSP00000410736
MSGPTWLPPKQPEPARAPQGRAIPRGTPGPPPAHGAGAPCRQGGPSPWKPGRRDRLAEQHAGRAEWGSGSCVTATRPTGI

SEQ ID NO: 88799 - protein, 106 aa, Homo sapiens
  Payload ID: 17777
  Gene Name: thyroid hormone receptor interactor 6
  Uniprot ID: Q15654
  ENSP ID: ENSP00000413817
MSGPTWLPPKQPEPARAPQGRAIPRGTPGPPPAHGAVLPGPRGTGGSGAGVGGVPWSTPAHAGAPCRQGGPSPWKPGRRDRLAEQHAGRAEWGSGSCVTATRPTGI

SEQ ID NO: 88800 - protein, 80 aa, Homo sapiens; identical to SEQ ID NO: 88798
  Payload ID: 17777
  Gene Name: thyroid hormone receptor interactor 6
  Uniprot ID: Q15654
  ENSP ID: ENSP00000479865

SEQ ID NO: 88801 - protein, 339 aa, Homo sapiens
  Payload ID: 17777
  Gene Name: thyroid hormone receptor interactor 6
  ENSP ID: ENSP00000486847
MSGPTWLPPKQPEDRGPAWVGSHGVLQHTQGLPADRGGLRPGSLDAEIDLLSSTLAELNGGRGHASRRPDRQAYEPPPPPAYRTGSLKPNPASPLPASPYGGPTPASYTTASTPAGPAFPVQVKVAQPVRGCGPPRRGASQASGPLPGPHFPLPGRGEVWGPGYRSQREPGPGAKEEAAGVSGPAGRGRGGEHGPQVPLSQPPEDELDRLTKKLVHDMNHPPSGEYFGQCGGCGEDVVGDGAGVVALDRVFHVGCFVCSTCRAQLRGQHFYAVERRAYCEGCYVVSGWGWEEGVSGWMQGASIQGGNSVQDQRRNGAKSQATESDVQTGRNSASIKQVA

SEQ ID NO: 88802 - protein, 490 aa, Homo sapiens
  Payload ID: 17778
  Gene Name: thyroid hormone receptor, alpha
  Uniprot ID: P10827
  ENSP ID: ENSP00000264637
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQSSILYKGAAAEGRPGGSLGVHPEGQQLLGMHVVQGPQVRQLEQQLGEAGSLQGPVLQHQSPKSPQQRLLELLHRSGILHARAVCGEDDSSEADSPSSSEEEPEVCEDLAGNAASP

SEQ ID NO: 88803 - protein, 490 aa, Homo sapiens; identical to SEQ ID NO: 88802
  Payload ID: 17778
  Gene Name: thyroid hormone receptor, alpha
  Uniprot ID: P10827
  ENSP ID: ENSP00000377679

SEQ ID NO: 88804 - protein, 410 aa, Homo sapiens
  Payload ID: 17778
  Gene Name: thyroid hormone receptor, alpha
  Uniprot ID: P10827
  ENSP ID: ENSP00000395641
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKVTDLRMIGACHASRFLHMKVECPTELFPPLFLEVFEDQEV

SEQ ID NO: 88805 - protein, 410 aa, Homo sapiens; identical to SEQ ID NO: 88804
  Payload ID: 17778
  Gene Name: thyroid hormone receptor, alpha
  Uniprot ID: P10827
  ENSP ID: ENSP00000443972

SEQ ID NO: 88806 - protein, 72 aa, Homo sapiens
  Payload ID: 17778
  Gene Name: thyroid hormone receptor, alpha
  ENSP ID: ENSP00000462955
MEQKPSKVECGSDPEENSARSPDGKRKRKNGQCSLKTSMSGYIPSYLDKDEQCVVCGDKATGYHYRCITCEG

SEQ ID NO: 88807 - protein, 451 aa, Homo sapiens
  Payload ID: 17778
  Gene Name: thyroid hormone receptor, alpha
  Uniprot ID: P10827
  ENSP ID: ENSP00000463466
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKGPQVRQLEQQLGEAGSLQGPVLQHQSPKSPQQRLLELLHRSGILHARAVCGEDDSSEADSPSSSEEEPEVCEDLAGNAASP

SEQ ID NO: 88808 - protein, 31 aa, Homo sapiens
  Payload ID: 17778
  Gene Name: thyroid hormone receptor, alpha
  ENSP ID: ENSP00000464013
MEQKPSKVECGSDPEENSARSPDGKRKRKNG

SEQ ID NO: 88809 - protein, 84 aa, Homo sapiens
  Payload ID: 17778
  Gene Name: thyroid hormone receptor, alpha
  ENSP ID: ENSP00000464123
MEQKPSKVECGSDPEENSARSPDGKRKRKNGQCSLKTSMSGYIPSYLDKDEQCVVCGDKATGYHYRCITCEGCKGFFRRTIQKN

SEQ ID NO: 88810 - protein, 57 aa, Homo sapiens
  Payload ID: 17778
  Gene Name: thyroid hormone receptor, alpha
  ENSP ID: ENSP00000464414
MEQKPSKVECGSDPEENSARSPDGKRKRKNGQCSLKTSMSGYIPSYLDKDEQCVVCG

SEQ ID NO: 88811 - protein, 476 aa, Homo sapiens
  Payload ID: 17779
  Gene Name: thyroid hormone receptor, beta
  Uniprot ID: P10828
  ENSP ID: ENSP00000280696
MNYCMQEIYEVHPAAGSNCYMQSTDYYAYFEDSPGYSGCDAQAVPSNNIYMEQAWAVNQPYTCSYPGNMFKSKDSDLDMALNQYSQPEYFTEEKPTFSQVQSPSYSQKKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 88812 - protein, 461 aa, Homo sapiens
  Payload ID: 17779
  Gene Name: thyroid hormone receptor, beta
  Uniprot ID: P10828
  ENSP ID: ENSP00000348827
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 88813 - protein, 461 aa, Homo sapiens; identical to SEQ ID NO: 88812
  Payload ID: 17779
  Gene Name: thyroid hormone receptor, beta
  Uniprot ID: P10828
  ENSP ID: ENSP00000379904

SEQ ID NO: 88814 - protein, 122 aa, Homo sapiens
  Payload ID: 17779
  Gene Name: thyroid hormone receptor, beta
  ENSP ID: ENSP00000388467
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCI

SEQ ID NO: 88815 - protein, 63 aa, Homo sapiens
  Payload ID: 17779
  Gene Name: thyroid hormone receptor, beta
  ENSP ID: ENSP00000393932
MTPNSMTENGLTAWDKPKHCPDREHDWKLVGMSEACLHRKSHSERRSTLKNEQSSPHLIQTTW

SEQ ID NO: 88816 - protein, 114 aa, Homo sapiens
  Payload ID: 17779
  Gene Name: thyroid hormone receptor, beta
  ENSP ID: ENSP00000395362
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKA

SEQ ID NO: 88817 - protein, 103 aa, Homo sapiens
  Payload ID: 17779
  Gene Name: thyroid hormone receptor, beta
  ENSP ID: ENSP00000399573
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDK

SEQ ID NO: 88818 - protein, 67 aa, Homo sapiens
  Payload ID: 17779
  Gene Name: thyroid hormone receptor, beta
  ENSP ID: ENSP00000404233
MTPNSMTENGLTAWDKPKHCPDREHDWKLVGMSEACLHRKSHSERRSTLKNEQSSPHLIQTTWTSSI

SEQ ID NO: 88819 - protein, 122 aa, Homo sapiens; identical to SEQ ID NO: 88814
  Payload ID: 17779
  Gene Name: thyroid hormone receptor, beta
  ENSP ID: ENSP00000404898

SEQ ID NO: 88820 - protein, 132 aa, Homo sapiens
  Payload ID: 17779
  Gene Name: thyroid hormone receptor, beta
  ENSP ID: ENSP00000414100
MSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQE

SEQ ID NO: 88821 - protein, 461 aa, Homo sapiens; identical to SEQ ID NO: 88812
  Payload ID: 17779
  Gene Name: thyroid hormone receptor, beta
  Uniprot ID: P10828
  ENSP ID: ENSP00000414444

SEQ ID NO: 88822 - protein, 121 aa, Homo sapiens
  Payload ID: 17779
  Gene Name: thyroid hormone receptor, beta
  ENSP ID: ENSP00000414910
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRC

SEQ ID NO: 88823 - protein, 146 aa, Homo sapiens
  Payload ID: 17780
  Gene Name: thyroid hormone responsive
  Uniprot ID: Q92748
  ENSP ID: ENSP00000281030
MQVLTKRYPKNCLLTVMDRYAAEVHNMEQVVMIPSLLRDVQLSGPGGQAQAEAPDLYTYFTMLKAICVDVDHGLLPREEWQAKVAGSEENGTAETEEVEDESASGELDLEAQFHLHFSSLHHILMHLTEKAQEVTRKYQEMTGQVW

SEQ ID NO: 88824 - protein, 889 aa, Homo sapiens
  Payload ID: 17781
  Gene Name: thyroid peroxidase
  Uniprot ID: P07202
  ENSP ID: ENSP00000263886
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 88825 - protein, 933 aa, Homo sapiens
  Payload ID: 17781
  Gene Name: thyroid peroxidase
  Uniprot ID: P07202
  ENSP ID: ENSP00000318820
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 88826 - protein, 933 aa, Homo sapiens; identical to SEQ ID NO: 88825
  Payload ID: 17781
  Gene Name: thyroid peroxidase
  Uniprot ID: P07202
  ENSP ID: ENSP00000329869

SEQ ID NO: 88827 - protein, 760 aa, Homo sapiens
  Payload ID: 17781
  Gene Name: thyroid peroxidase
  Uniprot ID: P07202
  ENSP ID: ENSP00000371633
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 88828 - protein, 876 aa, Homo sapiens
  Payload ID: 17781
  Gene Name: thyroid peroxidase
  Uniprot ID: P07202
  ENSP ID: ENSP00000371636
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 88829 - protein, 174 aa, Homo sapiens
  Payload ID: 17781
  Gene Name: thyroid peroxidase
  ENSP ID: ENSP00000371704
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRKMKYKPDHSETAN

SEQ ID NO: 88830 - protein, 171 aa, Homo sapiens
  Payload ID: 17781
  Gene Name: thyroid peroxidase
  ENSP ID: ENSP00000390994
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNT

SEQ ID NO: 88831 - protein, 404 aa, Homo sapiens
  Payload ID: 17781
  Gene Name: thyroid peroxidase
  ENSP ID: ENSP00000400033
  MOD_RES (1)..(1): Any amino acid
XYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWRVLGWKAGILTGCREPSEGKVAGHCRTASCSQNHRTTLFQTQANPKSAGRLFSQHG

SEQ ID NO: 88832 - protein, 864 aa, Homo sapiens
  Payload ID: 17781
  Gene Name: thyroid peroxidase
  ENSP ID: ENSP00000405788
QLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQVGHTMPHVSSCHRSGWTGSGCRSSSAGAPCIFLFTPCFLVRSAPSSGRFYLQANDSEPECEPA

SEQ ID NO: 88833 - protein, 363 aa, Homo sapiens
  Payload ID: 17781
  Gene Name: thyroid peroxidase
  ENSP ID: ENSP00000419461
YEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 88834 - protein, 174 aa, Homo sapiens; identical to SEQ ID NO: 88829
  Payload ID: 17781
  Gene Name: thyroid peroxidase
  ENSP ID: ENSP00000444840

SEQ ID NO: 88835 - protein, 174 aa, Homo sapiens; identical to SEQ ID NO: 88829
  Payload ID: 17781
  Gene Name: thyroid peroxidase
  ENSP ID: ENSP00000480200

SEQ ID NO: 88836 - protein, 889 aa, Homo sapiens
  Payload ID: 17781
  Gene Name: thyroid peroxidase
  ENSP ID: ENSP00000481794
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGSDCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 88837 - protein, 933 aa, Homo sapiens
  Payload ID: 17781
  Gene Name: thyroid peroxidase
  ENSP ID: ENSP00000482926
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGSDCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 88838 - protein, 859 aa, Homo sapiens
  Payload ID: 17781
  Gene Name: thyroid peroxidase
  ENSP ID: ENSP00000486403
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGSDCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQ

SEQ ID NO: 88839 - protein, 864 aa, Homo sapiens
  Payload ID: 17781
  Gene Name: thyroid peroxidase
  ENSP ID: ENSP00000486520
QLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGSDCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQVGHTMPHVSSCHRSGWTGSGCRSSSAGAPCIFLFTPCFLVRSAPSSGRFYLQANDSEPECEPA

SEQ ID NO: 88840 - protein, 743 aa, Homo sapiens
  Payload ID: 17781
  Gene Name: thyroid peroxidase
  ENSP ID: ENSP00000486538
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGSDCQMTCENQNPCFPIQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQ

SEQ ID NO: 88841 - protein, 171 aa, Homo sapiens; identical to SEQ ID NO: 88830
  Payload ID: 17781
  Gene Name: thyroid peroxidase
  ENSP ID: ENSP00000486958

SEQ ID NO: 88842 - protein, 347 aa, Homo sapiens
  Payload ID: 17781
  Gene Name: thyroid peroxidase
  ENSP ID: ENSP00000487159
  MOD_RES (1)..(1): Any amino acid
XYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICR

SEQ ID NO: 88843 - protein, 916 aa, Homo sapiens
  Payload ID: 17781
  Gene Name: thyroid peroxidase
  ENSP ID: ENSP00000487200
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGSDCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQ

SEQ ID NO: 88844 - protein, 346 aa, Homo sapiens
  Payload ID: 17781
  Gene Name: thyroid peroxidase
  ENSP ID: ENSP00000487272
YEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQ

SEQ ID NO: 88845 - protein, 174 aa, Homo sapiens; identical to SEQ ID NO: 88829
  Payload ID: 17781
  Gene Name: thyroid peroxidase
  ENSP ID: ENSP00000487562

SEQ ID NO: 88846 - protein, 764 aa, Homo sapiens
  Payload ID: 17782
  Gene Name: thyroid stimulating hormone receptor
  ENSP ID: ENSP00000298171
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 88847 - protein, 253 aa, Homo sapiens
  Payload ID: 17782
  Gene Name: thyroid stimulating hormone receptor
  Uniprot ID: P16473
  ENSP ID: ENSP00000340113
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLLPLGRKSLSFETQKAPRSSMPS

SEQ ID NO: 88848 - protein, 764 aa, Homo sapiens; identical to SEQ ID NO: 88846
  Payload ID: 17782
  Gene Name: thyroid stimulating hormone receptor
  ENSP ID: ENSP00000441235

SEQ ID NO: 88849 - protein, 274 aa, Homo sapiens
  Payload ID: 17782
  Gene Name: thyroid stimulating hormone receptor
  Uniprot ID: P16473
  ENSP ID: ENSP00000450549
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLVENVAVSGKGFCKSLFSWLYRLPLGRKSLSFETQKAPRSSMPS

SEQ ID NO: 88850 - protein, 112 aa, Homo sapiens
  Payload ID: 17782
  Gene Name: thyroid stimulating hormone receptor
  ENSP ID: ENSP00000451092
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHITDTDAL

SEQ ID NO: 88851 - protein, 231 aa, Homo sapiens
  Payload ID: 17782
  Gene Name: thyroid stimulating hormone receptor
  ENSP ID: ENSP00000451202
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLL

SEQ ID NO: 88852 - protein, 138 aa, Homo sapiens
  Payload ID: 17783
  Gene Name: thyroid stimulating hormone, beta
  Uniprot ID: P01222
  ENSP ID: ENSP00000256592
MTALFLMSMLFGLTCGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 88853 - protein, 138 aa, Homo sapiens; identical to SEQ ID NO: 88852
  Payload ID: 17783
  Gene Name: thyroid stimulating hormone, beta
  Uniprot ID: P01222
  ENSP ID: ENSP00000358530

SEQ ID NO: 88854 - protein, 303 aa, Homo sapiens
  Payload ID: 17784
  Gene Name: thyrotrophic embryonic factor
  Uniprot ID: Q10587
  ENSP ID: ENSP00000266304
MSDAGGGKKPPVDPQAGPGPGPGRAAGERGLSGSFPLVLKKLMENPPREARLDKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 88855 - protein, 273 aa, Homo sapiens
  Payload ID: 17784
  Gene Name: thyrotrophic embryonic factor
  Uniprot ID: Q10587
  ENSP ID: ENSP00000385256
MDMPEVLKSLLEHSLPWPEKRTDKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 88856 - protein, 184 aa, Homo sapiens
  Payload ID: 17784
  Gene Name: thyrotrophic embryonic factor
  ENSP ID: ENSP00000411170
  MOD_RES (1)..(1): Any amino acid
XFIFLPRPGTSLGRIRKADKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPM

SEQ ID NO: 88857 - protein, 242 aa, Homo sapiens
  Payload ID: 17785
  Gene Name: thyrotropin-releasing hormone
  Uniprot ID: P20396
  ENSP ID: ENSP00000303452
MPGPWLLLALALTLNLTGVPGGRAQPEAAQQEAVTAAEHPGLDDFLRQVERLLFLRENIQRLQGDQGEHSASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 88858 - protein, 238 aa, Homo sapiens
  Payload ID: 17785
  Gene Name: thyrotropin-releasing hormone
  ENSP ID: ENSP00000426522
MPGPWLLLALALTLNLTGVPGGRAQPEAAQQEAVTAAEHPGLDDFLRQVERLLFLRENIQRLQGDQASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 88859 - protein, 1024 aa, Homo sapiens
  Payload ID: 17786
  Gene Name: thyrotropin-releasing hormone degrading enzyme
  Uniprot ID: Q9UKU6
  ENSP ID: ENSP00000261180
MGEDDAALRAGSRGLSDPWADSVGVRPRTTERHIAVHKRLVLAFAVSLVALLAVTMLAVLLSLRFDECGASATPGADGGPSGFPERGGNGSLPGSARRNHHAGGDSWQPEAGGVASPGTTSAQPPSEEEREPWEPWTQLRLSGHLKPLHYNLMLTAFMENFTFSGEVNVEIACRNATRYVVLHASRVAVEKVQLAEDRAFGAVPVAGFFLYPQTQVLVVVLNRTLDAQRNYNLKIIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVVRLYARPDAIRRGSGDYALHITKRLIEFYEDYFKVPYSLPKLDLLAVPKHPYAAMENWGLSIFVEQRILLDPSVSSISYLLDVTMVIVHEICHQWFGDLVTPVWWEDVWLKEGFAHYFEFVGTDYLYPGWNMEKQRFLTDVLHEVMLLDGLASSHPVSQEVLQATDIDRVFDWIAYKKGAALIRMLANFMGHSVFQRGLQDYLTIHKYGNAARNDLWNTLSEALKRNGKYVNIQEVMDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLARAGYLPQNIPLEIIRYLSEEKDFLPWHAASRALYPLDKLLDRMENYNIFNEYILKQVATTYIKLGWPKNNFNGSLVQASYQHEELRREVIMLACSFGNKHCHQQASTLISDWISSNRNRIPLNVRDIVYCTGVSLLDEDVWEFIWMKFHSTTAVSEKKILLEALTCSDDRNLLNRLLNLSLNSEVVLDQDAIDVIIHVARNPHGRDLAWKFFRDKWKILNTRYGEALFMNSKLISGVTEFLNTEGELKELKNFMKNYDGVAAASFSRAVETVEANVRWKMLYQDELFQWLGKALRH

SEQ ID NO: 88860 - protein, 194 aa, Homo sapiens
  Payload ID: 17786
  Gene Name: thyrotropin-releasing hormone degrading enzyme
  ENSP ID: ENSP00000447822
  MOD_RES (1)..(1): Any amino acid
XIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVGAALIRMLANFMGHSVFQRGLQDYLTIHKYGNAARNDLWNTLSEALKRNGKYVNIQEVMDQWTLQMGYPVITILGNT

SEQ ID NO: 88861 - protein, 398 aa, Homo sapiens
  Payload ID: 17787
  Gene Name: thyrotropin-releasing hormone receptor
  Uniprot ID: P34981
  ENSP ID: ENSP00000309818
MENETVSELNQTQLQPRAVVALEYQVVTILLVLIICGLGIVGNIMVVLVVMRTKHMRTPTNCYLVSLAVADLMVLVAAGLPNITDSIYGSWVYGYVGCLCITYLQYLGINASSCSITAFTIERYIAICHPIKAQFLCTFSRAKKIIIFVWAFTSLYCMLWFFLLDLNISTYKDAIVISCGYKISRNYYSPIYLMDFGVFYVVPMILATVLYGFIARILFLNPIPSDPKENSKTWKNDSTHQNTNLNVNTSNRCFNSTVSSRKQVTKMLAVVVILFALLWMPYRTLVVVNSFLSSPFQENWFLLFCRICIYLNSAINPVIYNLMSQKFRAAFRKLCNCKQKPTEKPANYSVALNYSVIKESDHFSTELDDITVTDTYLSATKVSFDDTCLASEVSFSQS

SEQ ID NO: 88862 - protein, 398 aa, Homo sapiens; identical to SEQ ID NO: 88861
  Payload ID: 17787
  Gene Name: thyrotropin-releasing hormone receptor
  Uniprot ID: P34981
  ENSP ID: ENSP00000430711

SEQ ID NO: 88863 - protein, 385 aa, Homo sapiens
  Payload ID: 17788
  Gene Name: TIA1 cytotoxic granule-associated RNA binding protein
  ENSP ID: ENSP00000282574
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 88864 - protein, 152 aa, Homo sapiens
  Payload ID: 17788
  Gene Name: TIA1 cytotoxic granule-associated RNA binding protein
  ENSP ID: ENSP00000354838
  MOD_RES (1)..(1): Any amino acid
XYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWVSSVRSAWIMLKE

SEQ ID NO: 88865 - protein, 285 aa, Homo sapiens
  Payload ID: 17788
  Gene Name: TIA1 cytotoxic granule-associated RNA binding protein
  ENSP ID: ENSP00000399567
MEDEMPKTLYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRQTQSSAPWMGPNYGVQPPQGQNGSMLPNQPSGYRVAGYETQ

SEQ ID NO: 88866 - protein, 386 aa, Homo sapiens
  Payload ID: 17788
  Gene Name: TIA1 cytotoxic granule-associated RNA binding protein
  Uniprot ID: P31483
  ENSP ID: ENSP00000401371
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 88867 - protein, 114 aa, Homo sapiens
  Payload ID: 17788
  Gene Name: TIA1 cytotoxic granule-associated RNA binding protein
  ENSP ID: ENSP00000402263
MRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQG

SEQ ID NO: 88868 - protein, 375 aa, Homo sapiens
  Payload ID: 17788
  Gene Name: TIA1 cytotoxic granule-associated RNA binding protein
  Uniprot ID: P31483
  ENSP ID: ENSP00000404023
MEDEMPKTLYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 88869 - protein, 214 aa, Homo sapiens
  Payload ID: 17788
  Gene Name: TIA1 cytotoxic granule-associated RNA binding protein
  Uniprot ID: P31483
  ENSP ID: ENSP00000413751
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYECRCIGEEKEMWNFGEKYARF

SEQ ID NO: 88870 - protein, 161 aa, Homo sapiens
  Payload ID: 17788
  Gene Name: TIA1 cytotoxic granule-associated RNA binding protein
  ENSP ID: ENSP00000427794
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQVLVHLHMDSHKLNGVMSGQPKLLAFEKTVKYFNIKLLQCKIISMSLLVISAQKLQLKI

SEQ ID NO: 88871 - protein, 144 aa, Homo sapiens
  Payload ID: 17788
  Gene Name: TIA1 cytotoxic granule-associated RNA binding protein
  ENSP ID: ENSP00000430969
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISVSLKNGQNCPG

SEQ ID NO: 88872 - protein, 85 aa, Homo sapiens
  Payload ID: 17789
  Gene Name: TIA1 cytotoxic granule-associated RNA binding protein-like 1
  ENSP ID: ENSP00000358082
MITEHTSNDPYCFVEFYEHRDAAAALAAMNGRKILGKEVKVNWATTPSSQKKDTSNHFHVFVGDLSPEITTEDIKSAFAPFGKIS

SEQ ID NO: 88873 - protein, 392 aa, Homo sapiens
  Payload ID: 17789
  Gene Name: TIA1 cytotoxic granule-associated RNA binding protein-like 1
  Uniprot ID: Q01085
  ENSP ID: ENSP00000358089
MMEDDGQPRTLYVGNLSRDVTEVLILQLFSQIGPCKSCKMITEQPDSRRVNSSVGFSVLQHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 88874 - protein, 375 aa, Homo sapiens
  Payload ID: 17789
  Gene Name: TIA1 cytotoxic granule-associated RNA binding protein-like 1
  Uniprot ID: Q01085
  ENSP ID: ENSP00000394902
MMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 88875 - protein, 132 aa, Homo sapiens
  Payload ID: 17789
  Gene Name: TIA1 cytotoxic granule-associated RNA binding protein-like 1
  ENSP ID: ENSP00000403573
MITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTN

SEQ ID NO: 88876 - protein, 135 aa, Homo sapiens
  Payload ID: 17789
  Gene Name: TIA1 cytotoxic granule-associated RNA binding protein-like 1
  ENSP ID: ENSP00000431009
MMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISIAHKNGQDLEG

SEQ ID NO: 88877 - protein, 28 aa, Homo sapiens
  Payload ID: 17789
  Gene Name: TIA1 cytotoxic granule-associated RNA binding protein-like 1
  ENSP ID: ENSP00000480825
MMEDDGQPRTLHTQAKTYGSIFRKQYGV

SEQ ID NO: 88878 - protein, 591 aa, Homo sapiens
  Payload ID: 17790
  Gene Name: tigger transposable element derived 1
  Uniprot ID: Q96MW7
  ENSP ID: ENSP00000386186
MASKCSSERKSRTSLTLNQKLEMIKLSEEGMSKAEIGRRLGLLRQTVSQVVNAKEKFLKEVKSATPMNTRMIRKRNSLIADMEKVLVVWIEDQTSRNIPLSQSLIQNKALTLFNSMKAERGVEAAEEKFEASRGWFMRFKERSHFHNIKAQGEAASADVEAAASYPEALAKIIDEGGYTKQQIFNVDETAFYWKKMPSRTFIAREEKSVPGFKASKDRLTLLLGANAAGDFKLKPMLIYHSENPRALKNYTKSTLPVLYKWNSKARMTAHLFTAWFTEYFKPTVETYCSEKKIPFKILLLIDNAPSHPRALMEIYEEINVIFMPANTTSILQPMDQGVISTFKSYYLRNTFHKALAAMDSDVSDGSGQSKLKTFWKGFTILDAIKNIRDSWEEVKLSTLTGVWKKLIPTLIDDYEGFKTSVEEVSADVVEIAKELELEVEPEDVTELLQSHDKTLTDEELFLMDAQRKWFLEMESTPGEDAVNIVEMTTKDLEYYINLVDKAAAGFERIDSNFERSSTVGKMLSNSIACYREIFHERKSQLMRKASPMSYFRKLPQPPQPSAATTLTSQQPSTSRQDPPPAKRVRLTEGSD

SEQ ID NO: 88879 - protein, 525 aa, Homo sapiens
  Payload ID: 17791
  Gene Name: tigger transposable element derived 2
  Uniprot ID: Q4W5G0
  ENSP ID: ENSP00000317170
MLGKRKRVVLTIKDKLDIIKKLEEGISFKKLSVVYGIGESTVRDIKKNKERIINYANSSDPTSGVSKRKSMKSSTYEELDRVMIEWFNQQKTDGIPVSGTICAKQAKFFFDALGMEGDFNASSGWLTRFKQRHGIPKAAGKGTKLKGDETAAREFCGSFQEFVEKENLQPEQIYGADQTGLFWKCLPSRTLTLETDQSTSGCRSSRERIIIMCCANATGLHKLNLCVVGKAKKPRAFKGTDLSNLPVTYYSQKGAWIEQSVFRQWFEKYFVPQVQKHLKSKGLLEKAVLLLDFPPARPNEEMLSSDDGRIIVKYLPPNVTSLIQPMSQGVLATVKRYYRAGLLQKYMDEGNDPKIFWKNLTVLDAIYEVSRAWNMVKSSTITKAWKKLFPGNEENSGMNIDEGAILAANLATVLQNTEECEHVDIENIDQWFDSRSSDSSCQVLTDSESAEDQTKAAEQKPSSKSRKTELNPEKHISHKAALEWTENLLDYLEQQDDMLLSDKLVLRRLRTIIRKKQKIQNNKNH

SEQ ID NO: 88880 - protein, 525 aa, Homo sapiens; identical to SEQ ID NO: 88879
  Payload ID: 17791
  Gene Name: tigger transposable element derived 2
  Uniprot ID: Q4W5G0
  ENSP ID: ENSP00000486687

SEQ ID NO: 88881 - protein, 471 aa, Homo sapiens
  Payload ID: 17792
  Gene Name: tigger transposable element derived 3
  Uniprot ID: Q6B0B8
  ENSP ID: ENSP00000308354
MELSSKKKLHALSLAEKIQVLELLDESKMSQSEVARRFQVSQPQISRICKNKEKLLADWCSGTANRERKRKRESKYSGIDEALLCWYHIARAKAWDVTGPMLLHKAKELADIMGQDFVPSIGWLVRWKRRNNVGFGARHVLAPSFPPEPPPPGLTSQAQLPLSLKDFSPEDVFGCAELPLLYRAVPGSFGACDQVQVLLCANSRGTEKRRVLLGGLQAAPRCFFGIRSEALPASYHPDLGIPWLEWLAQFDRDMGQQGRQVALLLAARVVEELAGLPGLYHVKLLPLAASSTTPPLPSSVVRAFKAHYRHRLLGKLAAIQSERDGTSLAEAGAGITVLDALHVASAAWAKVPPQLIFSSFIQEGLAPGKTPPSSHKTSEMPPVPGGLSLEEFSRFVDLEGEEPRSGVCKEEIGTEDEKGDREGAFEPLPTKADALRALGTLRRWFECNSTSPELFEKFYDCEEEVERLCCL

SEQ ID NO: 88882 - protein, 512 aa, Homo sapiens
  Payload ID: 17793
  Gene Name: tigger transposable element derived 4
  Uniprot ID: Q8IY51
  ENSP ID: ENSP00000355162
MAEASVDASTLPVTVKKKKSLSIEEKIDIINAVESGKKKAEIAAEYGIKKNSLSSIMKNKDKVLEAFESLRFDPKRKRLRTAFYTDLEEALMRWYRIAQCLNVPVNGPMLRLKANDFAQKLGHNDFKCSNGWLDRFKSRYGLVFRAQPVEATGVPVDPSTVWYQNVLPYYLNDYHPKNVFNIKETGLLYRMLPTNTFAFKGETCSVGKLCKDRITLVVGTNMDGSEKLPLLVIGKKRTPHCFKGLKSLPVCYEANRMAWMTSDVFEQWMRKLDEEFQAQQRRVVIFVESFPAHPEVKNLKSIELAFFPSCLSSKCIAMKQGVIKSLKIKYRHCLIKKFLSSVEGSKEFTFSLLDAVDTLHLCWRAVTPETIVKSYEEAGFKSQKGESDITNAEKDTGLDLVADALGAGVEFPEGLSIEEYAALDDDLETCEAAPNGDSICTKESKSDETGFYTSDEEDDDGSPGTELPLPSKSEAITALDTLKKFLRSQDMNDGLQNSLADLENFINSLSPK

SEQ ID NO: 88883 - protein, 642 aa, Homo sapiens
  Payload ID: 17794
  Gene Name: tigger transposable element derived 5
  Uniprot ID: Q53EQ6
  ENSP ID: ENSP00000315906
MYPAGPPAGPVPRRGRRPLPGPPAPAPAPVPAARPPPPAPGPRPRVAVKMAFRKAYSIKDKLQAIERVKGGERQASVCRDFGVPGGTLRGWLKDEPKLRWFLEQLGGEVGTQRKKMRLANEEEIDRAVYAWFLALRQHGVPLSGPLIQAQAEAFARQIYGPECTFKASHGWFWRWQKRHGISSQRFYGEAGPPAPSPAPGPPVKEEPALPSGAGPLPDRAPAPPPPAEGGYGDEQIYSASVTGLYWKLLPEQAAPPGAGDPGAGGCGRRWRGDRVTVLLAANLTGSHKLKPLVIGRLPDPPSLRHHNQDKFPASYRYSPDAWLSRPLLRGWFFEEFVPGVKRYLRRSCLQQKAVLLVAHPPCPSPAASMPALDSEDAPVRCRPEPLGPPEELQTPDGAVRVLFLSKGSSRAHIPAPLEQGVVAAFKQLYKRELLRLAVSCASGSPLDFMRSFMLKDMLYLAGLSWDLVQAGSIERCWLLGLRAAFEPRPGEDSAGQPAQAEEAAEHSRVLSDLTHLAALAYKCLAPEEVAEWLHLDDDGGPPEGCREEVGPALPPAAPPAPASLPSAMGGGEDEEEATDYGGTSVPTAGEAVRGLETALRWLENQDPREVGPLRLVQLRSLISMARRLGGIGHTPAGPYDGV

SEQ ID NO: 88884 - protein, 642 aa, Homo sapiens; identical to SEQ ID NO: 88883
  Payload ID: 17794
  Gene Name: tigger transposable element derived 5
  Uniprot ID: Q53EQ6
  ENSP ID: ENSP00000421489

SEQ ID NO: 88885 - protein, 521 aa, Homo sapiens
  Payload ID: 17795
  Gene Name: tigger transposable element derived 6
  Uniprot ID: Q17RP2
  ENSP ID: ENSP00000296736
MANKGNKKRRQFSLEEKMKVVGAVDSGKRKGDVAKEFGITPSTLSTFLKDRTKFEEKVREASVGPQRKRMRSALYDDIDKAVFAWFQEIHAKNILVTGSVIRKKALNLANMLGYDNFQASVGWLNRFRDRHGIALKAVCREDSDRLMNGLGIDKINEWHAGEIIKLIADYSPDDIFNADETGVFFQLLPQHTLAAKGDHCRGGKKAKQRLTALFCCNASGTEKMRPLIVGRSASPHCLKNIHSLPCDYRANQWAWMTRDLFNEWLMQVDARMKRAERRILLLIDNCSAHNMLPHLERIQVGYLPSNCTAVLQPLNLGIIHTMKVLYQSHLLKQILLKLNSSEDQEEVDIKQAIDMIAAAWWSVKPSTVVKCWQKAGIVPMEFAECDTESAASEPDIAIEKLWHTVAIATCVPNEVNFQDFVTADDDLIISQDTDIIQDMVAGENTSEAGSEDEGEVSLPEQPKVTITEAISSVQKLRQFLSTCVDIPDAIFGQLNGIDEYLMKRVTQTLIDSKITDFLQTK

SEQ ID NO: 88886 - protein, 521 aa, Homo sapiens; identical to SEQ ID NO: 88885
  Payload ID: 17795
  Gene Name: tigger transposable element derived 6
  Uniprot ID: Q17RP2
  ENSP ID: ENSP00000425318

SEQ ID NO: 88887 - protein, 549 aa, Homo sapiens
  Payload ID: 17796
  Gene Name: tigger transposable element derived 7
  Uniprot ID: Q6NT04
  ENSP ID: ENSP00000380071
MNKRGKYTTLNLEEKMKVLSRIEAGRSLKSVMDEFGISKSTFYDIKKNKKLILDFVLKQDMPLVGAEKRKRTTGAKYGDVDDAVYMWYQQKRSAGVPVRGVELQAAAERFARCFGRTDFKASTGWLFRFRNRHAIGNRKGCGEQVLSSVSENVEPFRQKLSMIIKEEKLCLAQLYSGDETDLFWKSMPENSQASRKDICLPGKKINKERLSAFLCANADGTHKLKSIIIGKSKLPKSVKEDTSTLPVIYKPSKDVWFTRELFSEWFFQNFVPEVRHFQLNVLRFHDEDVRALLLLDSCPAHPSSESLTSEDGRIKCMFFPHNTSTLIQPMNQGVILSCKRLYRWKQLEESLVIFEESDDEQEKGDKGVSKIKIYNIKSAIFNWAKSWEEVKQITIANAWENLLYKKEPEYDFQGLEHGDYREILEKCGELETKLDDDRVWLNGDEEKGCLLKTKGGITKEVVQKGGEAEKQTAEFKLSAVRESLDYLLDFVDATPEFQRFHFTLKEMQQEIVKKQFQSKIHSRIGSFLKPRPHNIKDSFSGPSTSGSNH

SEQ ID NO: 88888 - protein, 116 aa, Homo sapiens
  Payload ID: 17796
  Gene Name: tigger transposable element derived 7
  ENSP ID: ENSP00000459534
MNKRGKYTTLNLEEKMKVLSRIEAGRSLKSVMDEFGISKSTFYDIKKNKKLILDFVLKQDMPLVGAEKRKRTTGAKYGDVDDAVYMWYQQKRSAGVPVRGVELQAAAERFARCFGR

SEQ ID NO: 88889 - protein, 547 aa, Homo sapiens
  Payload ID: 17797
  Gene Name: tight junction associated protein 1 (peripheral)
  Uniprot ID: Q5JTD0
  ENSP ID: ENSP00000259751
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADLPCELQDMVRKHLHSGQEAASPGPAPSLAPGAVVPTSVIARVLEKPESLLLNSAQSGSAGRPLAEDVFVHVDMSEGVPGDPASPPAPGSPTPQPNGECHSLGTARGSPEEELPLPAFEKLNPYPTPSPPHPLYPGRRVIEFSEDKVRIPRNSPLPNCTYATRQAISLSLVEEGSERARPSPVPSTPASAQASPHHQPSPAPLTLSAPASSASSEEDLLVSWQRAFVDRTPPPAAVAQRTAFGRDALPELQRHFAHSPADRDEVVQAPSARPEESELLLPTEPDSGFPREEEELNLPISPEEERQSLLPINRGTEEGPGTSHTEGRAWPLPSSSRPQRSPKRMGVHHLHRKDSLTQAQEQGNLLN

SEQ ID NO: 88890 - protein, 547 aa, Homo sapiens; identical to SEQ ID NO: 88889
  Payload ID: 17797
  Gene Name: tight junction associated protein 1 (peripheral)
  Uniprot ID: Q5JTD0
  ENSP ID: ENSP00000361521

SEQ ID NO: 88891 - protein, 557 aa, Homo sapiens
  Payload ID: 17797
  Gene Name: tight junction associated protein 1 (peripheral)
  Uniprot ID: Q5JTD0
  ENSP ID: ENSP00000361522
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLASLSHSWIFAIKKAEMDRKTLDWEIVELTNKLLDAKNTINKLEELNERYRLDCNLAVQLLKCNKSHFRNHKFADLPCELQDMVRKHLHSGQEAASPGPAPSLAPGAVVPTSVIARVLEKPESLLLNSAQSGSAGRPLAEDVFVHVDMSEGVPGDPASPPAPGSPTPQPNGECHSLGTARGSPEEELPLPAFEKLNPYPTPSPPHPLYPGRRVIEFSEDKVRIPRNSPLPNCTYATRQAISLSLVEEGSERARPSPVPSTPASAQASPHHQPSPAPLTLSAPASSASSEEDLLVSWQRAFVDRTPPPAAVAQRTAFGRDALPELQRHFAHSPADRDEVVQAPSARPEESELLLPTEPDSGFPREEEELNLPISPEEERQSLLPINRGTEEGPGTSHTEGRAWPLPSSSRPQRSPKRMGVHHLHRKDSLTQAQEQGNLLN

SEQ ID NO: 88892 - protein, 557 aa, Homo sapiens; identical to SEQ ID NO: 88891
  Payload ID: 17797
  Gene Name: tight junction associated protein 1 (peripheral)
  Uniprot ID: Q5JTD0
  ENSP ID: ENSP00000361527

SEQ ID NO: 88893 - protein, 547 aa, Homo sapiens; identical to SEQ ID NO: 88889
  Payload ID: 17797
  Gene Name: tight junction associated protein 1 (peripheral)
  Uniprot ID: Q5JTD0
  ENSP ID: ENSP00000361530

SEQ ID NO: 88894 - protein, 100 aa, Homo sapiens
  Payload ID: 17797
  Gene Name: tight junction associated protein 1 (peripheral)
  ENSP ID: ENSP00000361532
MTSAAPAKKPYRKAPPEHRELRLEIPGSRLEQEEPLTDAERMKLLQEENEELRRRLASATRRTEALERELEIGQDCLELELGQSREELDKFKDKFRRLQN

SEQ ID NO: 88895 - protein, 193 aa, Homo sapiens
  Payload ID: 17797
  Gene Name: tight junction associated protein 1 (peripheral)
  ENSP ID: ENSP00000390981
MTSAAPAKKPYRKAPPEHRELRLEIPGSRLEQEEPLTDAERMKLLQEENEELRRRLASATRRTEALERELEIGQDCLELELGQSREELDKFKDKFRRLQNSYTASQRTNQELEDKLHTLASLSHSWIFAIKKAEMDRKTLDWEIVELTNKLLDAKNTINKLEELNERYRLDCNLAVQLLKCNKSHFRNHKFAD

SEQ ID NO: 88896 - protein, 239 aa, Homo sapiens
  Payload ID: 17797
  Gene Name: tight junction associated protein 1 (peripheral)
  ENSP ID: ENSP00000391115
  MOD_RES (1)..(1): Any amino acid
XLLQEENEELRRRLASATRRTEALERELEIGQDCLELELGQSREELDKFKDKFRRLQNSYTASQRTNQELEDKLHTLIKKAEMDRKTLDWEIVELTNKLLDAKNTINKLEELNERYRLDCNLAVQLLKCNKSHFRNHKFADVSRTHPLPAHIDHSGHCRTPLTPVSAPLSVLLFPLCPPLASMSPLKPVNSATGWCPVYCPGPITSSGGPALLVSVTETEREDPGQEGEGSQSYLPKEY

SEQ ID NO: 88897 - protein, 547 aa, Homo sapiens; identical to SEQ ID NO: 88889
  Payload ID: 17797
  Gene Name: tight junction associated protein 1 (peripheral)
  Uniprot ID: Q5JTD0
  ENSP ID: ENSP00000407080

SEQ ID NO: 88898 - protein, 557 aa, Homo sapiens; identical to SEQ ID NO: 88891
  Payload ID: 17797
  Gene Name: tight junction associated protein 1 (peripheral)
  Uniprot ID: Q5JTD0
  ENSP ID: ENSP00000408769

SEQ ID NO: 88899 - protein, 43 aa, Homo sapiens
  Payload ID: 17797
  Gene Name: tight junction associated protein 1 (peripheral)
  Uniprot ID: Q5JTD0
  ENSP ID: ENSP00000484142
MTSAAPAKKPYRKAPPEHRELRLEIPGSRLEQEEPLTDAERMK

SEQ ID NO: 88900 - protein, 1748 aa, Homo sapiens
  Payload ID: 17798
  Gene Name: tight junction protein 1
  Uniprot ID: Q07157
  ENSP ID: ENSP00000281537
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 88901 - protein, 1768 aa, Homo sapiens
  Payload ID: 17798
  Gene Name: tight junction protein 1
  ENSP ID: ENSP00000348416
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 88902 - protein, 227 aa, Homo sapiens
  Payload ID: 17798
  Gene Name: tight junction protein 1
  ENSP ID: ENSP00000382887
  MOD_RES (1)..(1): Any amino acid
XKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGDPKTWQNKCLPGDPNYLVGANCVSVLIDHF

SEQ ID NO: 88903 - protein, 1692 aa, Homo sapiens
  Payload ID: 17798
  Gene Name: tight junction protein 1
  ENSP ID: ENSP00000382890
MERNTFSMDCHSKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 88904 - protein, 1668 aa, Homo sapiens
  Payload ID: 17798
  Gene Name: tight junction protein 1
  Uniprot ID: Q07157
  ENSP ID: ENSP00000441202
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 88905 - protein, 383 aa, Homo sapiens
  Payload ID: 17798
  Gene Name: tight junction protein 1
  ENSP ID: ENSP00000452729
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGRVTRTFENLKKIMILLSRKMCMCTYTQQLHTISGDSQGSIGHHLTHG

SEQ ID NO: 88906 - protein, 231 aa, Homo sapiens
  Payload ID: 17798
  Gene Name: tight junction protein 1
  ENSP ID: ENSP00000453334
MRRLEGLCLRRRRRRRGPARERSGDKMKYQKYLTVLQMAIGVTPSNRGSLLPLKRKLWVTPSSENPNGATSSVSQGKPSLRRIKGRLHRSKSLDSMDFCELTSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHD

SEQ ID NO: 88907 - protein, 1676 aa, Homo sapiens
  Payload ID: 17798
  Gene Name: tight junction protein 1
  ENSP ID: ENSP00000481375
MEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 88908 - protein, 1692 aa, Homo sapiens; identical to SEQ ID NO: 88903
  Payload ID: 17798
  Gene Name: tight junction protein 1
  ENSP ID: ENSP00000482697

SEQ ID NO: 88909 - protein, 1676 aa, Homo sapiens; identical to SEQ ID NO: 88907
  Payload ID: 17798
  Gene Name: tight junction protein 1
  ENSP ID: ENSP00000483470

SEQ ID NO: 88910 - protein, 1768 aa, Homo sapiens; identical to SEQ ID NO: 88901
  Payload ID: 17798
  Gene Name: tight junction protein 1
  Uniprot ID: Q07157
  ENSP ID: ENSP00000484535

SEQ ID NO: 88911 - protein, 383 aa, Homo sapiens; identical to SEQ ID NO: 88905
  Payload ID: 17798
  Gene Name: tight junction protein 1
  ENSP ID: ENSP00000486189

SEQ ID NO: 88912 - protein, 993 aa, Homo sapiens
  Payload ID: 17799
  Gene Name: tight junction protein 2
  Uniprot ID: Q9UDY2
  ENSP ID: ENSP00000265384
MPVRGDRGFPPRRELSGWLRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEVRRGRPRAGTGEPGVFLALSWTAVCSGCCGRHS

SEQ ID NO: 88913 - protein, 1043 aa, Homo sapiens
  Payload ID: 17799
  Gene Name: tight junction protein 2
  Uniprot ID: Q9UDY2
  ENSP ID: ENSP00000345893
MPVRGDRGFPPRRELSGWLRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 88914 - protein, 1190 aa, Homo sapiens
  Payload ID: 17799
  Gene Name: tight junction protein 2
  Uniprot ID: Q9UDY2
  ENSP ID: ENSP00000366453
MPVRGDRGFPPRRELSGWLRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 88915 - protein, 101 aa, Homo sapiens
  Payload ID: 17799
  Gene Name: tight junction protein 2
  ENSP ID: ENSP00000366469
MEELIWEQYTVTLQKDSKRGFGIAVSGGRDNPHFENGETSIVISDVLPGGPADGLLQENDRVVMVNGTPMEDVLHSFAVQQLRKSGKVAAIVSTGFAFSLP

SEQ ID NO: 88916 - protein, 1020 aa, Homo sapiens
  Payload ID: 17799
  Gene Name: tight junction protein 2
  Uniprot ID: Q9UDY2
  ENSP ID: ENSP00000392178
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 88917 - protein, 161 aa, Homo sapiens
  Payload ID: 17799
  Gene Name: tight junction protein 2
  ENSP ID: ENSP00000402941
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERA

SEQ ID NO: 88918 - protein, 1221 aa, Homo sapiens
  Payload ID: 17799
  Gene Name: tight junction protein 2
  Uniprot ID: Q9UDY2
  ENSP ID: ENSP00000438262
MKTAQALHRMWIQAVKKLRRWKGRVSPSASSPLVFPNLSSWEGEGSKTILTAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 88919 - protein, 1157 aa, Homo sapiens
  Payload ID: 17799
  Gene Name: tight junction protein 2
  Uniprot ID: Q9UDY2
  ENSP ID: ENSP00000442090
MKTAQALHRMWIQAVKKLRRWKGRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEEAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 88920 - protein, 134 aa, Homo sapiens
  Payload ID: 17799
  Gene Name: tight junction protein 2
  ENSP ID: ENSP00000475926
MEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSE

SEQ ID NO: 88921 - protein, 919 aa, Homo sapiens
  Payload ID: 17800
  Gene Name: tight junction protein 3
  Uniprot ID: O95049
  ENSP ID: ENSP00000439278
MEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 88922 - protein, 883 aa, Homo sapiens
  Payload ID: 17800
  Gene Name: tight junction protein 3
  Uniprot ID: O95049
  ENSP ID: ENSP00000439991
MVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 88923 - protein, 59 aa, Homo sapiens
  Payload ID: 17800
  Gene Name: tight junction protein 3
  ENSP ID: ENSP00000465065
  MOD_RES (1)..(1): Any amino acid
XLYAQAQKLRKHSSHLFTGAQGHHSRAADAAHLDGGRSAGWLLGGQPRPPSPRPGRQLR

SEQ ID NO: 88924 - protein, 928 aa, Homo sapiens
  Payload ID: 17800
  Gene Name: tight junction protein 3
  Uniprot ID: O95049
  ENSP ID: ENSP00000465419
MAVRFQVADMEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 88925 - protein, 938 aa, Homo sapiens
  Payload ID: 17800
  Gene Name: tight junction protein 3
  Uniprot ID: O95049
  ENSP ID: ENSP00000467864
MNLCGLMPIFPAPLDQVADMEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFMRVHDAESSDEDGYDWGPATDL

SEQ ID NO: 88926 - protein, 123 aa, Homo sapiens
  Payload ID: 17800
  Gene Name: tight junction protein 3
  ENSP ID: ENSP00000468641
MEELTIWEQHTATLSKQLFLPLILSQDPRRGFGIAISGGRDRPGGSMVVSDVVPGGPAEGRLQTGDHIVMVNGVSMENATSAFAIQILKTCTKMANITVKRPRRIHLPATKASPSSPGRQDSD

SEQ ID NO: 88927 - protein, 1207 aa, Homo sapiens
  Payload ID: 17801
  Gene Name: timeless circadian clock
  Uniprot ID: Q9UNS1
  ENSP ID: ENSP00000229201
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDISPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 88928 - protein, 1208 aa, Homo sapiens
  Payload ID: 17801
  Gene Name: timeless circadian clock
  Uniprot ID: Q9UNS1
  ENSP ID: ENSP00000450607
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDISPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLRELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 88929 - protein, 301 aa, Homo sapiens
  Payload ID: 17802
  Gene Name: TIMELESS interacting protein
  Uniprot ID: Q9BVW5
  ENSP ID: ENSP00000261881
MLEPQENGVIDLPDYEHVEDETFPPFPPPASPERQDGEGTEPDEESGNGAPVRVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 88930 - protein, 74 aa, Homo sapiens
  Payload ID: 17802
  Gene Name: TIMELESS interacting protein
  ENSP ID: ENSP00000455656
MLEPQENGVIDLPDYEHVEDETFPPFPPPASPERQDGEGTEPDEESGNGAPVRVPPKRTVKRNIPKLDAQRLKT

SEQ ID NO: 88931 - protein, 141 aa, Homo sapiens
  Payload ID: 17802
  Gene Name: TIMELESS interacting protein
  ENSP ID: ENSP00000457172
MLEPQENGVIDLPDYEHVEDETFPPFPPPASPERQDGEGTEPDEESGNGAPVRVPPKRTVKRNIPKLDAQRLISERGLPALRHVFDKAKFKGKGHEAEDLKMLIRHMEHWAHRLFPKLQFEDFIDRVEYLGSKKEVQVSVE

SEQ ID NO: 88932 - protein, 294 aa, Homo sapiens
  Payload ID: 17802
  Gene Name: TIMELESS interacting protein
  ENSP ID: ENSP00000457406
MLEPQENGVIDLPDYEHVEDETFPPFPPPASPERQDGEGTEPDEESGNGAPVRVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATS

SEQ ID NO: 88933 - protein, 116 aa, Homo sapiens
  Payload ID: 17802
  Gene Name: TIMELESS interacting protein
  ENSP ID: ENSP00000458117
MLEPQENGVIDLPDYEHVEDETFPPFPPPASPERQDGEGTEPDEESGNGAPVRVPPKRTVKRNIPKLDAQRLISERGLPALRHVFDKAKFKGKGHEAEDLKMLIRHMEHWAHRLFP

SEQ ID NO: 88934 - protein, 207 aa, Homo sapiens
  Payload ID: 17803
  Gene Name: TIMP metallopeptidase inhibitor 1
  Uniprot ID: P01033
  ENSP ID: ENSP00000218388
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 88935 - protein, 143 aa, Homo sapiens
  Payload ID: 17803
  Gene Name: TIMP metallopeptidase inhibitor 1
  ENSP ID: ENSP00000366216
MTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 88936 - protein, 95 aa, Homo sapiens
  Payload ID: 17803
  Gene Name: TIMP metallopeptidase inhibitor 1
  ENSP ID: ENSP00000405380
MPVYSAWPAEPTMAPFEPLASGILLLLWLIAPSRACTCVPPHPQTAFCNSDLVIRAKFVGTPEVNQTTLYQRYEIKMTKMYKGFQALGDAADIRF

SEQ ID NO: 88937 - protein, 136 aa, Homo sapiens
  Payload ID: 17803
  Gene Name: TIMP metallopeptidase inhibitor 1
  ENSP ID: ENSP00000406671
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGEAPSPRPVPHQPVPGARPSNHEGARL

SEQ ID NO: 88938 - protein, 165 aa, Homo sapiens
  Payload ID: 17803
  Gene Name: TIMP metallopeptidase inhibitor 1
  ENSP ID: ENSP00000410983
  MOD_RES (1)..(1): Any amino acid
XPRALCHTNQSLGRGLATTRGRGSDGNGPTGNGDHPNFSLSEGRAFGSLAAQPITSCLSVPAPPFSLGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 88939 - protein, 220 aa, Homo sapiens
  Payload ID: 17804
  Gene Name: TIMP metallopeptidase inhibitor 2
  Uniprot ID: P16035
  ENSP ID: ENSP00000262768
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 88940 - protein, 143 aa, Homo sapiens
  Payload ID: 17804
  Gene Name: TIMP metallopeptidase inhibitor 2
  ENSP ID: ENSP00000441724
MFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 88941 - protein, 109 aa, Homo sapiens
  Payload ID: 17804
  Gene Name: TIMP metallopeptidase inhibitor 2
  ENSP ID: ENSP00000464930
MFKGPEKDIEFIYTAPSSAVCGVSLDVGGKKEYLIAGKAEGDGKMHITLCDFIVPWDTLSTTQKKSLNHRYQMGCECKVSRSCLCWSIASSQCLQMDGRDFDPWLSRTR

SEQ ID NO: 88942 - protein, 143 aa, Homo sapiens; identical to SEQ ID NO: 88940
  Payload ID: 17804
  Gene Name: TIMP metallopeptidase inhibitor 2
  ENSP ID: ENSP00000467584

SEQ ID NO: 88943 - protein, 143 aa, Homo sapiens; identical to SEQ ID NO: 88940
  Payload ID: 17804
  Gene Name: TIMP metallopeptidase inhibitor 2
  ENSP ID: ENSP00000468296

SEQ ID NO: 88944 - protein, 211 aa, Homo sapiens
  Payload ID: 17805
  Gene Name: TIMP metallopeptidase inhibitor 3
  Uniprot ID: P35625
  ENSP ID: ENSP00000266085
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 88945 - protein, 224 aa, Homo sapiens
  Payload ID: 17806
  Gene Name: TIMP metallopeptidase inhibitor 4
  Uniprot ID: Q99727
  ENSP ID: ENSP00000287814
MPGSPRPAPSWVLLLRLLALLRPPGLGEACSCAPAHPQQHICHSALVIRAKISSEKVVPASADPADTEKMLRYEIKQIKMFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 88946 - protein, 304 aa, Homo sapiens
  Payload ID: 17807
  Gene Name: tissue factor pathway inhibitor (lipoprotein-associated coagulation inhibitor)
  Uniprot ID: P10646
  ENSP ID: ENSP00000233156
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 88947 - protein, 251 aa, Homo sapiens
  Payload ID: 17807
  Gene Name: tissue factor pathway inhibitor (lipoprotein-associated coagulation inhibitor)
  Uniprot ID: P10646
  ENSP ID: ENSP00000342306
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFVTKEGTNDGWKNAAHIYQVFLNAFCIHASMFFLGLDSISCLC

SEQ ID NO: 88948 - protein, 304 aa, Homo sapiens; identical to SEQ ID NO: 88946
  Payload ID: 17807
  Gene Name: tissue factor pathway inhibitor (lipoprotein-associated coagulation inhibitor)
  Uniprot ID: P10646
  ENSP ID: ENSP00000376172

SEQ ID NO: 88949 - protein, 251 aa, Homo sapiens; identical to SEQ ID NO: 88947
  Payload ID: 17807
  Gene Name: tissue factor pathway inhibitor (lipoprotein-associated coagulation inhibitor)
  Uniprot ID: P10646
  ENSP ID: ENSP00000386344

SEQ ID NO: 88950 - protein, 106 aa, Homo sapiens
  Payload ID: 17807
  Gene Name: tissue factor pathway inhibitor (lipoprotein-associated coagulation inhibitor)
  ENSP ID: ENSP00000388159
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTR

SEQ ID NO: 88951 - protein, 105 aa, Homo sapiens
  Payload ID: 17807
  Gene Name: tissue factor pathway inhibitor (lipoprotein-associated coagulation inhibitor)
  ENSP ID: ENSP00000394185
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCT

SEQ ID NO: 88952 - protein, 288 aa, Homo sapiens
  Payload ID: 17807
  Gene Name: tissue factor pathway inhibitor (lipoprotein-associated coagulation inhibitor)
  ENSP ID: ENSP00000397248
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRK

SEQ ID NO: 88953 - protein, 76 aa, Homo sapiens
  Payload ID: 17807
  Gene Name: tissue factor pathway inhibitor (lipoprotein-associated coagulation inhibitor)
  ENSP ID: ENSP00000400179
MIYTMKKVHALWASVCLLLNLAPAPLNADSEEDEEHTIITDTELPPLKLMHSFCAFKADDGPCKAIMKRFFFNIFT

SEQ ID NO: 88954 - protein, 61 aa, Homo sapiens
  Payload ID: 17807
  Gene Name: tissue factor pathway inhibitor (lipoprotein-associated coagulation inhibitor)
  ENSP ID: ENSP00000402954
MIYTMKKVHALWASVCLLLNLAPAPLNADSEEDEEHTIITDTELPPLKLMHSFCAFKADDG

SEQ ID NO: 88955 - protein, 106 aa, Homo sapiens; identical to SEQ ID NO: 88950
  Payload ID: 17807
  Gene Name: tissue factor pathway inhibitor (lipoprotein-associated coagulation inhibitor)
  ENSP ID: ENSP00000408170

SEQ ID NO: 88956 - protein, 215 aa, Homo sapiens
  Payload ID: 17807
  Gene Name: tissue factor pathway inhibitor (lipoprotein-associated coagulation inhibitor)
  ENSP ID: ENSP00000409177
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTREKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRA

SEQ ID NO: 88957 - protein, 235 aa, Homo sapiens
  Payload ID: 17808
  Gene Name: tissue factor pathway inhibitor 2
  Uniprot ID: P48307
  ENSP ID: ENSP00000222543
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 88958 - protein, 107 aa, Homo sapiens
  Payload ID: 17808
  Gene Name: tissue factor pathway inhibitor 2
  ENSP ID: ENSP00000416370
EACDDACWRIEKVPKVCRLQVSVDDQCEGSTEKYFFNLSSMTCEKFFSGGCHRNRIENRFPDEATCMGFCAPKKNTEPVMLSPILAVEGMTITLLAGRIANVHVQKL

SEQ ID NO: 88959 - protein, 321 aa, Homo sapiens
  Payload ID: 17809
  Gene Name: tissue specific transplantation antigen P35B
  Uniprot ID: Q13630
  ENSP ID: ENSP00000398803
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 88960 - protein, 268 aa, Homo sapiens
  Payload ID: 17809
  Gene Name: tissue specific transplantation antigen P35B
  ENSP ID: ENSP00000431587
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGE

SEQ ID NO: 88961 - protein, 64 aa, Homo sapiens
  Payload ID: 17809
  Gene Name: tissue specific transplantation antigen P35B
  ENSP ID: ENSP00000432088
TVGEEDEVSIKEAAEAVVEAMDFHGEVTFDTTKSDGQFKKTASNSKLRTYLPDFRFTPFKQGEP

SEQ ID NO: 88962 - protein, 118 aa, Homo sapiens
  Payload ID: 17809
  Gene Name: tissue specific transplantation antigen P35B
  ENSP ID: ENSP00000433331
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIF

SEQ ID NO: 88963 - protein, 33 aa, Homo sapiens
  Payload ID: 17809
  Gene Name: tissue specific transplantation antigen P35B
  ENSP ID: ENSP00000435240
MVGGLFRNIKYNLDFWRKNVHMNDNVLHSAFEV

SEQ ID NO: 88964 - protein, 321 aa, Homo sapiens; identical to SEQ ID NO: 88959
  Payload ID: 17809
  Gene Name: tissue specific transplantation antigen P35B
  Uniprot ID: Q13630
  ENSP ID: ENSP00000435386

SEQ ID NO: 88965 - protein, 115 aa, Homo sapiens
  Payload ID: 17809
  Gene Name: tissue specific transplantation antigen P35B
  ENSP ID: ENSP00000436405
MGEPQGSMRILVTGGSGLVGKAIQKVVADGAGLPGEDWVFVSSKDADLTWLAWPGCAWLCSWKNKHPPISSWKPAPSYQPGPGATLPFDCPSCHSPTQFLHLAPNPGVLVPSRAS

SEQ ID NO: 88966 - protein, 198 aa, Homo sapiens
  Payload ID: 17809
  Gene Name: tissue specific transplantation antigen P35B
  ENSP ID: ENSP00000437012
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLA

SEQ ID NO: 88967 - protein, 321 aa, Homo sapiens; identical to SEQ ID NO: 88959
  Payload ID: 17809
  Gene Name: tissue specific transplantation antigen P35B
  Uniprot ID: Q13630
  ENSP ID: ENSP00000478042

SEQ ID NO: 88968 - protein, 321 aa, Homo sapiens; identical to SEQ ID NO: 88959
  Payload ID: 17809
  Gene Name: tissue specific transplantation antigen P35B
  Uniprot ID: Q13630
  ENSP ID: ENSP00000487640

SEQ ID NO: 88969 - protein, 115 aa, Homo sapiens; identical to SEQ ID NO: 88965
  Payload ID: 17809
  Gene Name: tissue specific transplantation antigen P35B
  ENSP ID: ENSP00000487853

SEQ ID NO: 88970 - protein, 64 aa, Homo sapiens; identical to SEQ ID NO: 88961
  Payload ID: 17809
  Gene Name: tissue specific transplantation antigen P35B
  ENSP ID: ENSP00000487980

SEQ ID NO: 88971 - protein, 221 aa, Homo sapiens
  Payload ID: 17809
  Gene Name: tissue specific transplantation antigen P35B
  ENSP ID: ENSP00000488203
MRALAANRVNDLCQEPPSQGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLA

SEQ ID NO: 88972 - protein, 118 aa, Homo sapiens; identical to SEQ ID NO: 88962
  Payload ID: 17809
  Gene Name: tissue specific transplantation antigen P35B
  ENSP ID: ENSP00000488379

SEQ ID NO: 88973 - protein, 33 aa, Homo sapiens; identical to SEQ ID NO: 88963
  Payload ID: 17809
  Gene Name: tissue specific transplantation antigen P35B
  ENSP ID: ENSP00000488496

SEQ ID NO: 88974 - protein, 268 aa, Homo sapiens; identical to SEQ ID NO: 88960
  Payload ID: 17809
  Gene Name: tissue specific transplantation antigen P35B
  ENSP ID: ENSP00000488614

SEQ ID NO: 88975 - protein, 27118 aa, Homo sapiens
  Payload ID: 17810
  Gene Name: titin
  ENSP ID: ENSP00000340554
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEVQALDRQSSGKDVRESTKSQAVADSSFTKEESKISQKEIKSFQGSSYEYEVQVFESVSQSSIHTAASVQDTQLCHTASLSQIAESTELSKECAKESTGEAPKIFLHLQDVTVKCGDTAQFLCVLKDDSFIDVTWTHEGAKIEESERLKQSQNGNIQFLTICNVQLVDQGLYSCIVHNDCGERTTSAVLSVEGAPESILHERIEQEIEMEMKEFSSSFLSAEEEGLHSAELQLSKINETLELLSESPVYPTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 88976 - protein, 32767 aa, Homo sapiens
  Payload ID: 17810
  Gene Name: titin
  Uniprot ID: Q8WZ42
  ENSP ID: ENSP00000343764
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKAAPVIKRKIEPLEVALGHLAKFTCEIQSAPNVRFQWFKAGREIYESDKCSIRSSKYISSLEILRTQVVDCGEYTCKASNEYGSVSCTATLTVTEAYPPTFLSRPKSLTTFVGKAAKFICTVTGTPVIETIWQKDGAALSPSPNWRISDAENKHILELSNLTIQDRGVYSCKASNKFGADICQAELIIIDKPHFIKELEPVQSAINKKVHLECQVDEDRKVTVTWSKDGQKLPPGKDYKICFEDKIATLEIPLAKLKDSGTYVCTASNEAGSSSCSATVTVREPPSFVKKVDPSYLMLPGESARLHCKLKGSPVIQVTWFKNNKELSESNTVRMYFVNSEAILDITDVKVEDSGSYSCEAVNDVGSDSCSTEIVIKEPPSFIKTLEPADIVRGTNALLQCEVSGTGPFEISWFKDKKQIRSSKKYRLFSQKSLVCLEIFSFNSADVGEYECVVANEVGKCGCMATHLLKEPPTFVKKVDDLIALGGQTVTLQAAVRGSEPISVTWMKGQEVIREDGKIKMSFSNGVAVLIIPDVQISFGGKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVNGTCRLDCKIAGSLPMRVSWFKDGKEIAASDRYRIAFVEGTASLEIIRVDMNDAGNFTCRATNSVGSKDSSGALIVQEPPSFVTKPGSKDVLPGSAVCLKSTFQGSTPLTIRWFKGNKELVSGGSCYITKEALESSLELYLVKTSDSGTYTCKVSNVAGGVECSANLFVKEPATFVEKLEPSQLLKKGDATQLACKVTGTPPIKITWFANDREIKESSKHRMSFVESTAVLRLTDVGIEDSGEYMCEAQNEAGSDHCSSIVIVKESPYFTKEFKPIEVLKEYDVMLLAEVAGTPPFEITWFKDNTILRSGRKYKTFIQDHLVSLQILKFVAADAGEYQCRVTNEVGSSICSARVTLREPPSFIKKIESTSSLRGGTAAFQATLKGSLPITVTWLKDSDEITEDDNIRMTFENNVASLYLSGIEVKHDGKYVCQAKNDAGIQRCSALLSVKEPATITEEAVSIDVTQGDPATLQVKFSGTKEITAKWFKDGQELTLGSKYKISVTDTVSILKIISTEKKDSGEYTFEVQNDVGRSSCKARINVLDLIIPPSFTKKLKKMDSIKGSFIDLECIVAGSHPISIQWFKDDQEISASEKYKFSFHDNTAFLEISQLEGTDSGTYTCSATNKAGHNQCSGHLTVKEPPYFVEKPQSQDVNPNTRVQLKALVGGTAPMTIKWFKDNKELHSGAARSVWKDDTSTSLELFAAKATDSGTYICQLSNDVGTATSKATLFVKEPPQFIKKPSPVLVLRNGQSTTFECQITGTPKIRVSWYLDGNEITAIQKHGISFIDGLATFQISGARVENSGTYVCEARNDAGTASCSIELKVKEPPTFIRELKPVEVVKYSDVELECEVTGTPPFEVTWLKNNREIRSSKKYTLTDRVSVFNLHITKCDPSDTGEYQCIVSNEGGSCSCSTRVALKEPPSFIKKIENTTTVLKSSATFQSTVAGSPPISITWLKDDQILDEDDNVYISFVDSVATLQIRSVDNGHSGRYTCQAKNESGVERCYAFLLVQEPAQIVEKAKSVDVTEKDPMTLECVVAGTPELKVKWLKDGKQIVPSRYFSMSFENNVASFRIQSVMKQDSGQYTFKVENDFGSSSCDAYLRVLDQNIPPSFTKKLTKMDKVLGSSIHMECKVSGSLPISAQWFKDGKEISTSAKYRLVCHERSVSLEVNNLELEDTANYTCKVSNVAGDDACSGILTVKEPPSFLVKPGRQQAIPDSTVEFKAILKGTPPFKIKWFKDDVELVSGPKCFIGLEGSTSFLNLYSVDASKTGQYTCHVTNDVGSDSCTTMLLVTEPPKFVKKLEASKIVKAGDSSRLECKIAGSPEIRVVWFRNEHELPASDKYRMTFIDSVAVIQMNNLSTEDSGDFICEAQNPAGSTSCSTKVIVKEPPVFSSFPPIVETLKNAEVSLECELSGTPPFEVVWYKDKRQLRSSKKYKIASKNFHTSIHILNVDTSDIGEYHCKAQNEVGSDTCVCTVKLKEPPRFVSKLNSLTVVAGEPAELQASIEGAQPIFVQWLKEKEEVIRESENIRITFVENVATLQFAKAEPANAGKYICQIKNDGGMRENMATLMVLEPAVIVEKAGPMTVTVGETCTLECKVAGTPELSVEWYKDGKLLTSSQKHKFSFYNKISSLRILSVERQDAGTYTFQVQNNVGKSSCTAVVDVSDRAVPPSFTRRLKNTGGVLGASCILECKVAGSSPISVAWFHEKTKIVSGAKYQTTFSDNVCTLQLNSLDSSDMGNYTCVAANVAGSDECRAVLTVQEPPSFVKEPEPLEVLPGKNVTFTSVIRGTPPFKVNWFRGARELVKGDRCNIYFEDTVAELELFNIDISQSGEYTCVVSNNAGQASCTTRLFVKEPAAFLKRLSDHSVEPGKSIILESTYTGTLPISVTWKKDGFNITTSEKCNIVTTEKTCILEILNSTKRDAGQYSCEIENEAGRDVCGALVSTLEPPYFVTELEPLEAAVGDSVSLQCQVAGTPEITVSWYKGDTKLRPTPEYRTYFTNNVATLVFNKVNINDSGEYTCKAENSIGTASSKTVFRIQERQLPPSFARQLKDIEQTVGLPVTLTCRLNGSAPIQVCWYRDGVLLRDDENLQTSFVDNVATLKILQTDLSHSGQYSCSASNPLGTASSSARLTAREPKKSPFFDIKPVSIDVIAGESADFECHVTGAQPMRITWSKDNKEIRPGGNYTITCVGNTPHLRILKVGKGDSGQYTCQATNDVGKDMCSAQLSVKEPPKFVKKLEASKVAKQGESIQLECKISGSPEIKVSWFRNDSELHESWKYNMSFINSVALLTINEASAEDSGDYICEAHNGVGDASCSTALTVKAPPVFTQKPSPVGALKGSDVILQCEISGTPPFEVVWVKDRKQVRNSKKFKITSKHFDTSLHILNLEASDVGEYHCKATNEVGSDTCSCSVKFKEPPRFVKKLSDTSTLIGDAVELRAIVEGFQPISVVWLKDRGEVIRESENTRISFIDNIATLQLGSPEASNSGKYICQIKNDAGMRECSAVLTVLEPARIIEKPEPMTVTTGNPFALECVVTGTPELSAKWFKDGRELSADSKHHITFINKVASLKIPCAEMSDKGLYSFEVKNSVGKSNCTVSVHVSDRIVPPSFIRKLKDVNAILGASVVLECRVSGSAPISVGWFQDGNEIVSGPKCQSSFSENVCTLNLSLLEPSDTGIYTCVAANVAGSDECSAVLTVQEPPSFEQTPDSVEVLPGMSLTFTSVIRGTPPFKVKWFKGSRELVPGESCNISLEDFVTELELFEVQPLESGDYSCLVTNDAGSASCTTHLFVKEPATFVKRLADFSVETGSPIVLEATYTGTPPISVSWIKDEYLISQSERCSITMTEKSTILEILESTIEDYAQYSCLIENEAGQDICEALVSVLEPPYFIEPLEHVEAVIGEPATLQCKVDGTPEIRISWYKEHTKLRSAPAYKMQFKNNVASLVINKVDHSDVGEYSCKADNSVGAVASSAVLVIKARKLPPFFARKLKDVHETLGFPVAFECRINGSEPLQVSWYKDGVLLKDDANLQTSFVHNVATLQILQTDQSHIGQYNCSASNPLGTASSSAKLILSEHEVPPFFDLKPVSVDLALGESGTFKCHVTGTAPIKITWAKDNREIRPGGNYKMTLVENTATLTVLKVGKGDAGQYTCYASNIAGKDSCSAQLGVQEPPRFIKKLEPSRIVKQDEFTRYECKIGGSPEIKVLWYKDETEIQESSKFRMSFVDSVAVLEMHNLSVEDSGDYTCEAHNAAGSASSSTSLKVKEPPIFRKKPHPIETLKGADVHLECELQGTPPFHVSWYKDKRELRSGKKYKIMSENFLTSIHILNVDAADIGEYQCKATNDVGSDTCVGSIALKAPPRFVKKLSDISTVVGKEVQLQTTIEGAEPISVVWFKDKGEIVRESDNIWISYSENIATLQFSRVEPANAGKYTCQIKNDAGMQECFATLSVLEPATIVEKPESIKVTTGDTCTLECTVAGTPELSTKWFKDGKELTSDNKYKISFFNKVSGLKIINVAPSDSGVYSFEVQNPVGKDSCTASLQVSDRTVPPSFTRKLKETNGLSGSSVVMECKVYGSPPISVSWFHEGNEISSGRKYQTTLTDNTCALTVNMLEESDSGDYTCIATNMAGSDECSAPLTVREPPSFVQKPDPMDVLTGTNVTFTSIVKGTPPFSVSWFKGSSELVPGDRCNVSLEDSVAELELFDVDTSQSGEYTCIVSNEAGKASCTTHLYIKAPAKFVKRLNDYSIEKGKPLILEGTFTGTPPISVTWKKNGINVTPSQRCNITTTEKSAILEIPSSTVEDAGQYNCYIENASGKDSCSAQILILEPPYFVKQLEPVKVSVGDSASLQCQLAGTPEIGVSWYKGDTKLRPTTTYKMHFRNNVATLVFNQVDINDSGEYICKAENSVGEVSASTFLTVQEQKLPPSFSRQLRDVQETVGLPVVFDCAISGSEPISVSWYKDGKPLKDSPNVQTSFLDNTATLNIFKTDRSLAGQYSCTATNPIGSASSSARLILTEGKNPPFFDIRLAPVDAVVGESADFECHVTGTQPIKVSWAKDSREIRSGGKYQISYLENSAHLTVLKVDKGDSGQYTCYAVNEVGKDSCTAQLNIKERLIPPSFTKRLSETVEETEGNSFKLEGRVAGSQPITVAWYKNNIEIQPTSNCEITFKNNTLVLQVRKAGMNDAGLYTCKVSNDAGSALCTSSIVIKEPKKPPVFDQHLTPVTVSEGEYVQLSCHVQGSEPIRIQWLKAGREIKPSDRCSFSFASGTAVLELRDVAKADSGDYVCKASNVAGSDTTKSKVTIKDKPAVAPATKKAAVDGRLFFVSEPQSIRVVEKTTATFIAKVGGDPIPNVKWTKGKWRQLNQGGRVFIHQKGDEAKLEIRDTTKTDSGLYRCVAFNEHGEIESNVNLQVDERKKQEKIEGDLRAMLKKTPILKKGAGEEEEIDIMELLKNVDPKEYEKYARMYGITDFRGLLQAFELLKQSQEEETHRLEIEEIERSERDEKEFEELVSFIQQRLSQTEPVTLIKDIENQTVLKDNDAVFEIDIKINYPEIKLSWYKGTEKLEPSDKFEISIDGDRHTLRVKNCQLKDQGNYRLVCGPHIASAKLTVIEPAWERHLQDVTLKEGQTCTMTCQFSVPNVKSEWFRNGRILKPQGRHKTEVEHKVHKLTIADVRAEDQGQYTCKYEDLETSAELRIEAEPIQFTKRIQNIVVSEHQSATFECEVSFDDAIVTWYKGPTELTESQKYNFRNDGRCHYMTIHNVTPDDEGVYSVIARLEPRGEARSTAELYLTTKEIKLELKPPDIPDSRVPIPTMPIRAVPPEEIPPVVAPPIPLLLPTPEEKKPPPKRIEVTKKAVKKDAKKVVAKPKEMTPREEIVKKPPPPTTLIPAKAPEIIDVSSKAEEVKIMTITRKKEVQKEKEAVYEKKQAVHKEKRVFIESFEEPYDELEVEPYTEPFEQPYYEEPDEDYEEIKVEAKKEVHEEWEEDFEEGQEYYEREEGYDEGEEEWEEAYQEREVIQVQKEVYEESHERKVPAKVPEKKAPPPPKVIKKPVIEKIEKTSRRMEEEKVQVTKVPEVSKKIVPQKPSRTPVQEEVIEVKVPAVHTKKMVISEEKMFFASHTEEEVSVTVPEVQKEIVTEEKIHVAISKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEVQKGVVTEEKITIVTQREESPPPAVPEIPKKKVPEERKPVPRKEEEVPPPPKVPALPKKPVPEEKVAVPVPVAKKAPPPRAEVSKKTVVEEKRFVAEEKLSFAVPQRVEVTRHEVSAEEEWSYSEEEEGVSISVYREEEREEEEEAEVTEYEVMEEPEEYVVEEKLHIISKRVEAEPAEVTERQEKKIVLKPKIPAKIEEPPPAKVPEAPKKIVPEKKVPAPVPKKEKVPPPKVPEEPKKPVPEKKVPPKVIKMEEPLPAKVTERHMQITQEEKVLVAVTKKEAPPKARVPEEPKRAVPEEKVLKLKPKREEEPPAKVTEFRKRVVKEEKVSIEAPKREPQPIKEVTIMEEKERAYTLEEEAVSVQREEEYEEYEEYDYKEFEEYEPTEEYDQYEEYEEREYERYEEHEEYITEPEKPIPVKPVPEEPVPTKPKAPPAKVLKKAVPEEKVPVPIPKKLKPPPPKVPEEPKKVFEEKIRISITKREKEQVTEPAAKVPMKPKRVVAEEKVPVPRKEVAPPVRVPEVPKELEPEEVAFEEEVVTHVEEYLVEEEEEYIHEEEEFITEEEVVPVIPVKVPEVPRKPVPEEKKPVPVPKKKEAPPAKVPEVPKKPEEKVPVLIPKKEKPPPAKVPEVPKKPVPEEKVPVPVPKKVEAPPAKVPEVPKKPVPEKKVPVPAPKKVEAPPAKVPEVPKKLIPEEKKPTPVPKKVEAPPPKVPKKREPVPVPVALPQEEEVLFEEEIVPEEEVLPEEEEVLPEEEEVLPEEEEVLPEEEEIPPEEEEVPPEEEYVPEEEEFVPEEEVLPEVKPKVPVPAPVPEIKKKVTEKKVVIPKKEEAPPAKVPEVPKKVEEKRIILPKEEEVLPVEVTEEPEEEPISEEEIPEEPPSIEEVEEVAPPRVPEVIKKAVPEAPTPVPKKVEAPPAKVSKKIPEEKVPVPVQKKEAPPAKVPEVPKKVPEKKVLVPKKEAVPPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKVPEVLPPKEVVPEKKVPVPPAKKPEAPPPKVPEAPKEVVPEKKVPVPPPKKPEVPPTKVPEVPKAAVPEKKVPEAIPPKPESPPPEVPEAPKEVVPEKKVPAAPPKKPEVTPVKVPEAPKEVVPEKKVPVPPPKKPEVPPTKVPEVPKVAVPEKKVPEAIPPKPESPPPEVFEEPEEVALEEPPAEVVEEPEPAAPPQVTVPPKKPVPEKKAPAVVAKKPELPPVKVPEVPKEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFH

SEQ ID NO: 88977 - protein, 27051 aa, Homo sapiens
  Payload ID: 17810
  Gene Name: titin
  Uniprot ID: Q8WZ42
  ENSP ID: ENSP00000352154
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEGFSKFEENTSNSQWHVSLSVSFKKEPLGQKPSFIQPLSSLRVHNGETVRFHARVSGIPKPEIQWFHNQQLILPTKDVVFHFEESTGMALMLIVDAYSEHAGQYSCKAANSAGEATCAATLTVTPKAPESILHERIEQEIEMEMKEFSSSFLSAEEEGLHSAELQLSKINETLELLSESPVYPTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 88978 - protein, 5604 aa, Homo sapiens
  Payload ID: 17810
  Gene Name: titin
  Uniprot ID: Q8WZ42
  ENSP ID: ENSP00000354117
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKELFSEGESEHSERDTRDAFSDSEDIDHKSMAAKRYASRISSTSSWPEYFKPSFTQKLTFKYVLEGEPVVFTCRLIACPTPEMTWFHNNRPIPTGLRRIIKAESDLHHHSSSLEIKRVQDRDSGSYRLLAINSEGSAESTASLLVIQKGQDEKYLEFLKRAERTHENVEALVERGEDRIKVDLRFTGSPFNKKQDVEQKGMMRTIHFKTMSSAKKTDYMYDEEYLESKSDIRGWLNVGESFLDKETKVKLQRLREARKTLMEKKKLSLLDTSSEISSRTLRSEASDKDILFSREDMKIRSMSDLAESYKVDHSAESIVQNPHALSNQMDQNIESEELPTSFQTIVDEEIFQTEIRMSQEALVKESLPKDHLYGEILVNENTQARGQLEEIMANTTIGESSTYITNVCEKEEVYETPENVSQAITPHASESFGTLVNVEESEEIASERIKKDDLRELQLSASTRIDEFKTEQKEENMRFFENSFRKRPQRCPPSFLQEIESQEVYEGDSCNFVCHFQGYPQPIVTWYNNDMPIPRNQNFIIHSLENYSILTLSSVHHQNEGSITCVLFNQYGTVKTTSMLKVKAKQKHDVKAHKVPVFHDYLDEEEELALVFDQAKGAHPSMSQEGQTNLHLLKTNPPVPPSGDTELLSFPVEIQVTAATPIPEQDKESKEVFQTEELEPKAMPQDQVTQSPKHRFVFLSDITNEPPKMLQEMPKHARCREGDSIILECLISGEPQPVVTWFQNGVLLKQNQKFQFEEVNCSHQLYIKDVNSQDSGKYKCVAENNSGAVESVSDLTVEPVTYRENSQFENIGEIYGKYSRDQQLQDQGESVRAHFYDYPAGPFTPWTNVKEYSVRDYFQSLETIEQIDQKEQVRCIPSREKIPRFVHGASRTIKISKPIRAEFIQCQAEGKERHVSEKSKLHQAEGTVYPFVDDFSDVTIKKEIRNNFGKLGRSEKENVQECAQSDYLPNIHSERISDSYNTKDSSAIVYEESLGEEIHYPGKKVKHRIIEFEKLHVEKGVLEKRPTRTSIVNPPQKKIDDKAFSLKQRESRSSNLNANMYQAEKMSPNTESDSSNIAINLKLLSSQTHKEFDAQEREQQEKISLIDKPAISKRAEHESPITFDLKQFHTQIKHTDVKFQELDSGQPEEAYFKIQHPADTENIVFDLKQMYSHIGDPALEFQGQETREQQEIHYKEKIPSPETLQPDTHNISKSVQNNVFASQEISSSQELSNRTMVEKSSIDENSISLEKEVRHVQEQNLDILKTDLSLKSFSEEIYSESCALLPTSSADIEETDLSEKSCPLENGGRSSISHLKKAASEEKPLGVGEMEEECTLEPELAAFPKQDGGTQEYTDATLEDHRGDVQEADTLHRQLSLSQCFPLLMTEEQQNPGEQISTNIHASGEEKCYEEVQVQNEASFSTLEGEMIETSFSQNIPKLDEAHTTEAAESETSLTQYLLAAGKREVPETKDTRDQAKLVQSESITSMEVEEVTFNTVYEYYNQKQESLGRPLSPESDISIGVGSTTSEEISELDQFYTPPSSVEYFESPKSPDLYFNPSDITKQSSIHSGGETVERYSTPLGEVAERYSTPSEGEVGERYSTPPGETLERYSTPPGETLERYSTPPGETLERYSTPPGETLERYSTPPGETLERYSTPPGEALERYSIPTGGPNPTGTFKTYPSKIEREDGTPNEHFYTPTEERGSAYEIWRSDSFGTPNEAIEPKDNEMPPSFIEPLTKRKVYENTTLGFIVEVEGLPVPGVKWYRNKSLLEPDERIKMERVGNVCSLEISNIQKGEGGEYMCHAVNIIGEAKSFANVDIMPQEERVVALPPPVTHQHVMEFDLEHTTSSRTPSPQEIVLEVELSEKDVKEFEKQVKIVTVPEFTPDHKSMIVSLDVLPFNFVDPNMDSREGEDKELKIDLEVFEMPPRFIMPICDFKIPENSDAVFKCSVIGIPTPEVKWYKEYMCIEPDNIKYVISEEKGSHTLKIRNVCLSDSATYRCRAVNCVGEAICRGFLTMGDSEIFAVIAKKSKVTLSSLMEELVLKSNYTDSFFEFQVVEGPPRFIKGISDCYAPIGTAAYFQCLVRGSPRPTVYWYKDGKLVQGRRFTVEESGTGFHNLFITSLVKSDEGEYRCVATNKSGMAESFAALTLT

SEQ ID NO: 88979 - protein, 256 aa, Homo sapiens
  Payload ID: 17810
  Gene Name: titin
  ENSP ID: ENSP00000392336
  MOD_RES (1)..(1): Any amino acid
XEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPEPPPPKPVEEVEVPTVTKRERKIPEPTKVPEIKPAIPLPAPEPKPKPEAEVKTIK

SEQ ID NO: 88980 - protein, 48 aa, Homo sapiens
  Payload ID: 17810
  Gene Name: titin
  ENSP ID: ENSP00000394672
MTTQAPTFTQPLQSVVVLEGSTATFEAHISGFPVPEVSWFRDGQVIST

SEQ ID NO: 88981 - protein, 241 aa, Homo sapiens
  Payload ID: 17810
  Gene Name: titin
  ENSP ID: ENSP00000396805
  MOD_RES (1)..(1): Any amino acid
XRGIFPEVEPPEAIPEIPEHPPTEEFEVFKEVIPEGETPIVKRRKTPSPTAPEAMKEVVPEMKIFEDVPEEPETPRMKTPEAPQEIIPAKTVPSKKREPPSVKVPEALQEIVPEKKTLVVPLRKPEVLPDEVPEALREVVPEKKVHPPQRAEVVPVKVHEAPKEIIPEKKVSVVPPKKPEVPPVKVPEASKEVIREEKVPLAPPKEPEVPPVKVPEPPKEVVPEKKAPVAPPKEPEVPPVK

SEQ ID NO: 88982 - protein, 173 aa, Homo sapiens
  Payload ID: 17810
  Gene Name: titin
  ENSP ID: ENSP00000399176
  MOD_RES (1)..(1): Any amino acid
XPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKAPEVPKKIVPEEKVREA

SEQ ID NO: 88983 - protein, 962 aa, Homo sapiens [sequence omitted]

SEQ ID NO: 88984 - protein, 213 aa, Homo sapiens [sequence omitted]

SEQ ID NO: 88985 - protein, 372 aa, Homo sapiens
  Payload ID: 17810
  Gene Name: titin
  ENSP ID: ENSP00000408004
VVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEMPKKVVPVKKVPTVKKPETPAAKVPEVPKKLVPVKKEPVPVTKKPEVLPEKVPKVPEKIIPEKEVSVPIPAEPEVPPAEVEETPEEIIYEEKASITIGRKETPPVEEREIEKYIKPEEPEPEPQPEEIPVKEPEPEKVIEKPKLKPRPPPPPPAPPKEDVKEKIFQLKAIPKKKVPEKPQVPEKVELTPLKVPEPPPPKPVEEVEVPTVTKRERKIPEPTKVPEIKPAIPLP

SEQ ID NO: 88986 - protein, 26926 aa, Homo sapiens
  Payload ID: 17810
  Gene Name: titin
  Uniprot ID: Q8WZ42
  ENSP ID: ENSP00000434586
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKEFSSSFLSAEEEGLHSAELQLSKINETLELLSESPVYPTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI
